United States Patent 10,724,096 (METHODS AND COMPOSITIONS FOR INHIBITING AND TREATING NEUROLOGICAL CONDITIONS) - sequence listing, part 9

SEQ ID NO: 27 - DNA, 18527786 bp, Homo sapiens (residues 10,293,216-12,351,858 of 18,527,786)
  misc_feature (4041202)..(4061201): n is a, c, g, or t
tagttgagtttctatcagttgaatccaatagaatagatatcccacctcaaaacacacaaccagtgaatagcagacctagttgcattcttgatccaaagccaagttaccccctattaacccatggtatctcttgcctagacacaaattccgactggtacaaaggaaccactttggctcctggcacagacatttattgcattgcggggctaagctgcatcctttataggtagatctaagttttagaaattgctcaagattacacctgtggaaaaaaagagaaaacccagattacatctgtggaataaaactgaaagcccttccagaaaacactgaaaggaaataagcatgatgcactatgtatctatcatacacttggttttgaaagcatttctcagtgtgtctaagtctgatttgagccatggcctcctcattaccacaagtaaattgccaccaaaggaggcttctttgaaaagatacagggcacagaatgtggtcatcggaattggactcgattctccccttactgtgtgtataactgggtaatgtacttaacctctctatgcttcaggggcctggtgtataaattggggtaatgatagcttcttcatgcattgtttttcatagatgaaaggtaatcaaacacataaaacatctggaagaattcttgcacattgttgaccctcaacaaattatatatctctttatataaggggtatgttttatggatttatgcatattagacgttttaaggcattaatcctggtgtattgattaaaacatctgccttgttactctatcatcataccctgcaaagagctgggccactcccatttcatacacttccccgtgggctcattcttttagaaatagtcatcaggcacacacaaaaagcaatttaaatggttcatctttcctcttttcatccatagacaaatttcaataattatcttagtcaacccattaattagtctaaatttgcccaagcataattgatgctgcctacactattttctataaaaatttgaaatggatggctaaacagagattttttttgtttgtttgactaagtgcattttccctctatgcaaaatgtgttagtcaatgcttatctggtgtaataagcttagcttttagtgttcgtgtctacatctgtgatagaaagaagtttgaatctctaagttcaaattatgcattggcaatttctagcttgttgacttacggtctgccccttgaactctctgagaaaacctgtggccttacttgttgaatgggggtctggctgactagccctgccttctggaacccttcacctacctaggttttcccagataaacattggtatgactactatacccacatccttgagtactttgttttcctggaccttccccattccttgcttgtttgttttccctagggttccagtcattcttaatccctttctactatttagcaattcctggataatctgactgatctcaaactttcattaccacctatacatgaaggggatgcttctcttatgttaccatcagtctataacaccaactttgctgtgcatcattcttttctaacctctagagaattcttttcaacaggtgctgtgttcctcacagaaactattaagggaataaatatagggaaacctacaacagcataaaagcctcaaggtttgttgctggactcatgatgaagatgagaccagatgaaggaatacatgaaaggaataactttcaaaccagcttcctgagcaatttcagataccctgggaatcagatataggcaaacaatacctccttaacctgaattgggaagagagatggcagatgccactgaagacacatatgaagcacagagcaaaacatccagaagcaaacacaaacataaataaaaattcagaatctaaagatcgatcaatgcagcagaacaatgttacattattcaatagtcttgccataatgggttaagtgtgtgaaaaatatccaatcttatcccaaaataaatgctagatgaaataaagctctcagtgtagcacaaaagcaaacaaaaatgacaccacaatttagatgaatataaaattttttgcacgaaaatgtttttacaatacatcgaaaccaaaaccattaaaaataaatacatttaatcacataaaggatcatattttctcatgatcctaggccatcaacacattcaaaggcacatgtctaaattggaaaatatttgccatgcatagaaccaaccaagattaatgctgttaatacataaactgttcttacaaatcaatgagaaaactaatgagtatccccaaagaaaaatgtacaagggaagtaaattcgtagtttagaaaagaagaaatacaagtagccaggaagcatgaacaacagttccactttgggtatcaaagaaatgaaaattaaaacaataagatttttgatatatgatgtttttattcattaaaatgaaaaatagtctcaggtactggcaggcaagggcaataagaaccgccttgagtagcggtacagtcaattttagaggtcagcctggccctttttagtctatatctctattctacatctaaaatttcaaaatgtgaataagttttcacttggcaactctacttctaggaatttacctgaaagaatcatgtgaacttgcaatgacgcatgtacaacaatgctctctgaaatggtataataatggaaaattggaagtagcataaaattcaatgataggctagctcaaacaaaatctcttcccaaaagagttctttaaatttatttcttcttcctcactatgtgccattctgtgccaaacacacaccagtctttcttctccacacatttttcctttctttctcccacatatgcatttactttctctcagcccattttcactctctctcatttttaccttctatctcccccttccactcacatttactttccttcttactgaccatttttcttttctctaagccatttttgcttttcctctcatgcatgctgtcttcctttctcctttcccccaacactttttctttttctctgtcactgacttttaccttctctcttatatccatgtttacttcattctcacagttaatagttttacattctctctcttgcactttcattttctttcttacacatacttttacttgacctctctcccccacactttcactttctctcccacaccgtgacttttacacacacctttttatttttgttctcactcagttttcctctgtaacccagagaagagggtgaaatgtccagattagagtttatccagtcacggggcagccaggactgggttgagacctgaagcaggaggctgttgcagtattccaggatggagcttagttttttctaccaagcagcagtagcaggatggaggggaaaactgtggatgcagaagacatttctaaggtggagctgatgggtctgagcaaccgtttggtgaatgaatggtagcatctaagatgatgtcaaagtttctggcagggacagcagagtagaaaatgtcaccaaggccgcagaaagtggtaaaaggaaaaggcctgggtgttccttgatcctagagcacctatatctaaggcaatataatctttgcaggattttcagaccaaaaaaaacgttcttgggagaagagaaaagagtccgtaattgcctacagagagtccttgaattttgtttcttcaactgagcaattctccctcttgtatgccattcaggggcatccttaaaatatttttactccaatgtctataatactaatctgtatgtctttgtgtatccaaaaagcacttgtacccccaaacctactgaaattcttaaaaaaaaattctgtaaaacttaagcttcgtgcattaatggattttttaaaatagagctatcacaggataacaaattttgcccaccactagctaaatgctggctgcatcatctctttgcacaatgtcattgacacaattatatccccaaagggcttgcagactctgtgagggcagggaggctgtcctcactgctcagcacaggtcccaattgcctacaagagtaacagcctcttagtgggtactcaggaaatatgctgggatgaataaatatttaaaatctttctcatgttgtcagtcattattgttctgtaaaaactgaaaactgaagtgaaattatggaaccactcgcatttttgatgataagtgcaggcccataaacccgaggcaatgatggaaatcattaagcatcattggaagtggtacatttttagtttcaattggatgcttattggacttaagctggtcaaatttgtgctcaagtgtcaatgaaaagaacaaaattaaagatatattgaatgttggaaacagagctttgaagattttatgtaaaaggtgaggcaagttggggagttattattttttagatttcttgaagcaaacctcctcactccctaccacaaaaagaaaagctaagtcaaccgttccaacacagacatttgacttttatgcaatttttcaggaaagtattgtgttatggagtaggagctgcctgtcccaattgcttatcctagtatttcatctacagagacaggtgaattcttgtcagcagatcagattgtgggaggtgacagacagtccagctctccaatgtgaccttcagaataattcagagcattgctgctacactcctggggacagatggaaatctaatgggtacagaatgctctgggcctggaaggaaggatttaatgctcagagaggcacttggtacatcatccattgtttatcttcatgtaaaagattgtttaattaatcaactcaaagtattcatgctactttcccagggtctgaggatacagtcatagaaatactgataaaaatccctgccctcatggagctgacagtctagggcggccaggtgcagatagaaaatttaaaaactaaataagtaaaccatacagaacgataatagaacatgatgagtacgagagaaaaataaagcagcaatcacggcaggcagtttaggtgttgctagcaagcaactgcaactcccaatagggaagtcagggaagttgtgctaggatgtgttattgttcaatatccattatttcttccactccaagatgactatgcatcccggcatcccggacaccgccacgtaacttatagtccttccccgctggctgaggagacctccttgccccagagacaggaggtttgccatatgacttgttttgacaaatggaatatgagcaggtattgctgtacagaacatctaaaggaatgtacctgtgtcacttagctcaatctcttatgtctatcgtctaccatgaaaatgaaatgtcctagacaagggctggtcctcccacctgcttgtggaatgagaaaacatgtggcgagagccatgcctccagcaagcccacacctaggagggacgtgagcaaggaaaaaacaagtttgtcatgtaagccaatgataggatttttctgttaccaccataaagccgattaatataaaaaagcctttctaagaggtgacatttatgccaagactggaaagagataagatgataaaactgaggcccagagaagtgatgtaactctctcaaggcacacatctattaagcgacaaagactctattgaaaatctttctctctgcgtttgttcacactatctcctcaggcagggacttgcctagctcagatcacaaaacccacagggtcagcaatattttcccatcctggccaattgtatgtacagcctccatccttaagttacttgaggcacatggccctctcctgcaactgaagagaagtgtgactgagtctgcagctgaattcttccatctccttctcatcttttacatctcactagaaccctgcaattagcttgtgagacagggcaggatggtgaatatcaacatctcatatttacaaatgagaacacttaggctgggagctaagcgacttccttaaaatcatgaagtaagtggatattggcggtggaaaccccaccttcctgaaaccaagaatatcactgcatcacttgaatttttatatacttgagtatttgagcatcaattcgctatccctatatatatatatatcccctatctataatagatagatgaagaaattaaagctcagagacatgaagtaactctcagaagttctcacaacttagaagagcagattagaatcaaagatttttctcactccagaacctgtgcatggtatgagccctgtcctctttgtgactttctatgaggatgcagaatgatggctgttggccacgaaacacattgcacaatgttgttagtttaaagaagttcaatgaacattattgcttagtcaattcatcctcaactgagtgacattgctggtgcccagggagagccagattcaatgttcatgaggaagctgcatatcatgatgtgccttcaatcagaaagagctactccgcaccagggtctgagaccaccaccagccaaatgtctaagggaataacagtgagagggatgcgtgtctctctcccctgcacttttgctttgccagacacttttcgctactgggaaagactaacatcctatacatacagaaggcaacccagtgtggcagaggcaggatggttagggttggaagttcagctcttccatggaaaggctgtattgccttaagcaatgacctcaaaggcttgttttgcgggctcaccccacaactcattcattgattccttcattcacttatttaaatgtatattaagtactcattatatatcagttattattctagaccctaggaatacagcaatagcaaccagacagtctgctccgtgaatacctccaaacccttaccactgtttcactctaaatgtacagaatggctactctgctcctaccccttgctctgcaaaaagggcctctgcaactaacacagtagtcccccagatcacaggaggtctcagagccagagacaggtcatgggcaggtagaattcccctagaatctccatccctctgctaatacaagtaaaactgactcataaccccacctttcatgacacccttgggcagcccagcccagacaactctgctaccagaggtcaaactattagcccttctcaccatttttttaatgtttccaggtgagtagaagagcaaatggatccagacaatcaatagcaaggggacagaaagtcattgtggagtagcaacttttgcttgtataaaattgtaaaaacaaaaacaaactatcaagcaaaaatagacatacgaagaaaatggttgagtttcctatgtagagaaaaactggaaatgtgtacctcacctttgcttcctttacctggataagcccaatagcccagctccaatgttgaaattctcaggaaggctggaacagccattcccctgacccaggagacctttcccatggccaacccattgggcaattacaaatagaaatattctttcagttaaatgaatgaattacttgtttaactgaaaggtagttagtattgtcactgttggtgtttgttttaaacttttacattcaggggtataagtacaggtttgttatatagataaacttgtgtcatgggggtttgttgtagagacccctggtgttcatcactcaggtattaaacctagtaccctttagatatttttcctgatcatctcccttctcccaccttccaccctctgaaaggccccagtgtgtgttgttcccctctatgtgtccatgtgttctcatcatttacctcccacttataagtgacaacacacagtatttggttttgtcttccagcgttagttttctaagtttaatggccttcagctccatccacgtccctgaaaaagacatgatctcattcttttgtatggtacatgtaccatgttttctttatccagtctaccattgttgggcatttaggttgattccatgtttttgctatcgtgaatagtgctgcaatgaacatacacatgtatgtgtgtttataatacaatgatttatattcctttgagtataatcgtaatggggctgctgggtctaatggtatttctgtttttaggtctttgaggaattgccacaaaaagtaatctcatatactgttggtgggagtgtgtattattagcccagtcactgctgatcttgacaaacccataaagaagaaaatggactcacacggcacagaggggtatctcaaacccaactctactaatctcaaacccaactcaccctcatggattttccgattcccatcagtaccggcttagagttactcttctgacgaatattgcactgatgtaaccaccgacaatacagccacgtgcatttaccttaaagtgttgctccatgccagcttgtggctgatgcaaagctagctggccagaaataggatccttgggattcacgccagcttggggatcaacatccctaagactctgaacagaattctccatgtgaaggagttggacacactgtgaccaagatggaagctttcatgtgtcgactggatggtccccatcaaggctgtgtgagttttctgggtgaactccatgaggacaaacaccccaaaatgaggccaaaggccagatgttcctgcacggtctttccacagtcctaataatatccttagtgcttattatgaactatgggtgattatgctgatggaatagaacattgtagaggcttaaatctatataaatttctgcaaaattctgccctttgagcaggatttaatgtttaattccatgctgcctgatctgtgatgtatacaaggattccaagttataccattcacctgaaaatctgcaaaccaccctggaatttgtcttcatcgtctttctttttgtggccccagagaccatagttacagggaagcaaggctagatgggggaagcttctcgtcttagcaacatatgtaacttatgcaaagcagctagtagagtcctggcacccactaggtgagcagcaaacctgttttcttgtctctatgccatacttttgttttccaagaagttcatttgatagatttctaatacattccaagtttctgcctcacgatgtctaaaggcatgccattactattaaaggagggacagtaagtgaccagcaagagaatggaatgattaatctagagtctacagggcacggcatgacattatagtctcttccattgatgctctttgacccctgacttgaagaagctgggctctgagaagggagaacaacttggtctccaaacatctctgctgatgctattctaaatgcaaagaaatgtcaaagctgaaataaccataatgcaattgtacttagcctgtttgctgaaatatcagtcattgctttgcacagcaattccatttttaaagttcattgtgctagaaaaatgttgcagctccttaattcttacgttctcatccaagccgggtgggaggtgagaagtttttgaactgtatgaaaatccatatttcagcagcattaccgagctctctttcagcatcctgcacattttctcttccctgaacccagagaaatctcccacttccatggcctgccctcattttgacagcaaacattaaaagagcatcggcagaagcacagatgaaaaaagaacaacacagggttgctgagcacccatcctgttgtctgaggaggaccaggctcactgggaactctgggttgagtctggttcgctcaacctctaagggtatcaatgactgatgttctggaagccgacttctacaggttgcctcaatgggctcttggtttcgaacttctggttatattcagccaataggaggtacaggcatgggattggagaataggaggatggcgaggttgggcagtgattctctccctgcttttccatggtttgtacagtggctacattctcctacagcagcatttctcaacctcagttctattggtatttgaggccaaacaactgtttgtgatggagggtcatcttgtcttgtgtgttgttggatatttcaaagcattcctggcatctactcactgtgtgccagtagcacactcgccaggttgtgaccaaaatgtgaccaaaaatgtcctctgggggaatattgccaatttctcatagggagcaaaattgcctcagggtacatctctatagacggccctttcatttaattcccactgctaacccattcacaatgctctctgcaagtagctgggaccccaaggtaagtgaatactagtatatgtggtcctcaatatggattctctttgtatgtaattggaggtgctgtgtcctttagcagactgcaagccttctgagggcagtgactagggctcccgcataaagcacaccccacccaggaggcttcaagcacaatgtggccactggaaggaaacacttctaggtgctgctagaatcccaggggctttagtgaaactctctctttcctggattcctcctcagtggaagcagaatacacagggacactgctccctccactctccacccccagcctctttttataatgactcttcctgtctgtgggctacttcctcctggggaacagaaggtctaggaggcctctgaattggcaccagcgccctgtggttaacttgtgtctggcagcaaaagctgctggtccctaggatgcagcaatcacctctaaatgaggtctgcctttgctacatttaaggactgtaacaattgctttttctcccttggaaatataaccttagagatgaactgctcttgattcagtaaacgtctgtgccagtttccttagaggctaccatgagaaggtactagcctccttccacaaactcaagaggaaagcacaaacctgcaatcattgcccattttcctaagtccctgcatagggctgaggccaagggcagaggctgggccgggactctagaaggcagcagggaggtgtgttgggtctgagttgtttctggattgcaagtgtcattgatgcatatttaataccaatgacactgctctgctgtcactatcagtgccccatgcaagccttggggacatcttaaggaaaaaactggcataaatgatcccataggtgtgtccctgtgaagctgtgtttaaagttctcctagattatatttagatcctggcatggcttctccagttatggaactgtgtgtactgctgtttggttcttgccaggtctggtttttcatggagtcagggtgtgggcttagaatgctgatctccacacttggtcatgctgcttgcctttgccaagctagatgtgctaaaggagtgagggatcaggagaactctgttcctggcccccagtaagcaggtgctgccagttcacactgacacgcaccgctgaagagcataaaactataaaatggagtttctgcctcagtttccacatttgtgctagatttctgttgggactgctgcctcattgactgtaaccctcatactggctgttgttccccccaaaaccctctcagggatggaacctagagctagctgtacctccatccgattggtgatggaggaaatcacagttttattctcccctggctccagcgttgaaatcaggcagccttggtctaaaacattaactcagagccagtcacctcaccttctgggtttcagttgcttcgtctgtaaactaatgttgaatattttaatcctttcccactattttcttctgagctgtaatttgcattcagtaaaataaacaaatcttaagtgtacagcctaatgaatttctatacattcacatacctgtcatccaacccaatatagagaatacatttccagccctccagaattatcttgttccctaacctaggtaatgccacacccccatagggaaccactgttttggagttcatcaacatgagtagttttgcctgtttgtgaatgtcatatatatggaatcctacagtatatactgtttgcgtccagctttgtttgttcaacatataagttttgaggttaattcacattatggagtgtacagatagccagtccctttctgttgataaatagtattccactgtagcagtacaatacaacaatgtatccattctactttggatgtcatttgggttgttttcatttggagactattacaaataaagctattaccaacattcttatgtgggaatgtttatagaaatatgcattcatttctcctgcgtttattccatggtccagtaccagggatttaagcaccaaaattcattccacacttaagttcctcatcagcacattttgatgcccagaggcacctgaggctcagcaggttctacatggagtccatcaccctcatcactcagccctgacaatccctccaggctcagggctaaacatctcctccagggctacaggccagccatcctcagcttctagtgctttgaatatgccttattctccttctatcttcctggccttcagaataaattaaagtcagatgattacatcccctttatacagaaatatattctagaaagattaaaaactcgaaggcaaaacaaaacaaaacaataaaagtgctagaagaaaatctgaagtatcttttcatattcttgctttggttgcctaaaagtgtaataaggttaaaagcaaggaagaaagactgaaataaaaattaaaaacatctctatataaaaagagtataaagaagacaaatctgttaaaaactaaataaatttatttagtttattctttactactaatgtgtcgaaaaacacatattatccttaatacgcaaagggctcttgcaaaataataagagatgtgtaaagctccccaaagaaaaaaatgcataaagaagtagcaactggtaatataaaggtccaataagcaagaaaaagttgctcaacataatcaatcaacaaagaataacacattaaaacaagctattattttttactaatcagattagttttcagacaattgatggttttgggaaattagacctctcatatgctcttggtagaattataaatcaatacctcttttccaagaagatattcctatgatgatcaaacaccatataaatgtggccaagtaattcaatttctaggaagatgtcccaaggaaatggttgtatatatacacaaagatatgtaccagcctgttcataacagaagtgcataaaaatttaaaacctgaaacaacccaaatgcccagaaataggaaaatcatgaagtaaagtagggtacatacatataatggaattatatgcagccattaaggtgattggataaatatgtctttatcatggagagctgttcatatcctttttgagagactgaagtaggttgcaaaaaataagtcaagatatgattccattattgtgcatgtgcgtgtgtgcacacacatgcccacggcaagtgtttggaaggtgttctattcagggtaagtgaacctcagtaacctcaaagatttaacacaagaaagatttctttttcgctcgtgtcacagtcaaaaatgaatctgcagggtggctctgcttcactttgtcattgaaaagcccaggctccttctatcggtggctccactgtcccaaagagtcttgaagtccccctctggaccctctgtatctcaccatcagaagagggaagaaacagtgggggtggggtgtttacagggccagggctggaggtgactcatttcttcccaaataccactaaaacataaccacagggtaacccctaactgcaaaggggctgagaggtgtagccttgctgtatacccagcaaccgcctagtctccttcacagaaagaaacagcaaaattctaacatgattaggtctggctagaaatatttgggatcaactttgctttctcctttcactcttccacattgcccagacttttcccaaaagatgtgggctacttttagaataagagcagaaaagcccaatacagctattgccagccttccatatttgcaggttctgcatctgcagattcaaccaatcatggactgaaaatatttgaagaaaaaacaattagaaataacaatacaacagtaaaataccagcaaactaacacaggaacagaaaaccaaacaccgcatgttttcactcataagtgggggttgaacaatgagaacacatggacacagggagggtaacatcacacactggggcctgtcaggaggttgttggggggacaagggaagggagagcattaaggcattaagacaaatacctaatgcatgaagggctcaaaacctagatgacgggttgatgggtgcaggaaaccaccatggcacatgtatatctatgtaacaaacctgcacgttctgcacatgtatctcagaacttaaagcaaaataaaaataataataatacaaataaagaaatacagtaaaacaactatttacatagcatttgtattgcactgggtgttgtaagtaacctagagatgatttaaagtatacaggaggatgtgtataaattacatgcaaatacgacctcattttatatgaagaacttgagcatccaagaattttagtatccaaggagggtgccggaaccaatctcctgaggatactgagggtcaaccgtatttccattctgatggctttgcagaggaatcagacagtcctccactgtaaatcaagctgcaattagtgccctggtgttctggcgccccgggtccttcgtgttagagctgggacatgaagacagcacccgagaagaagggggcctgaaatatccctggctgcccttcacatctcaaaagacacagacactagtccccaaggcagctcacagcccacccacctggaactttctccatgcctgggaggcctcaaactgagaagcaaaccccacgttgctgtgtgacagggcctgcttctgtccgcctaggtgcacaagtgcatcccaccactcagaggaatactccccacaccaccatttgtcactgtcagcccagggagcaattatattccatccggccagaaataaacagacaccagcatcacacaggagatgacaggcagacacactgcctctgatgcacacacgtttttctcatgcccagctgtgactgagcctctgggcacagatgcagcccagagcctggtgggaaaagcaaatcaatgagggcccttagaggatctcgtaagctctctcaccacttgctcttttcaggtagaatgaacgaatttggggaaaagcctaacttttaaattaaacagttgtaaaacttctgataaaaatgccattaaagaaatttatgagattaaacacatctctatggcttctcctgcagatcagcctgtgggtctgaaggcctttggatcaaggggatgagcgcattggtgtgggagccggggcagggagtggggtttgagctcctgcagcactgcttaacagctgtgcagtcccagctgggtcctgtaaccttcctgccttccaaagggcaatattaccacttgcccttcctccctgcttttattaatgcaattttctctgcttcatatacactcctacatcctccttatggcagagacgacttgctctctcccaaattcactctcaccttccatcacacagggctgtagctaggaagcagctactcagctagagagtatatttcctaccctatgttggctatgtgtggcttcaagacaaggcttttttacattgtgcacatgtaccctaaaacttaaagtataattaaaaaaaaatagattcaattttatttatttattttctcttttgagacagagtctcactctgtcacccaggctggaggtctgtggtacaatcatggctcactgcaacctcaacctctcgggctgaagtgatcctaccacctcagcctcccaagtagctgggattacgtgtgtgcagcaccatgcccagctaatttttgtatttttcatagacacgggttctccctttgttgctcaggctggtcctgaactcctgggctcaagtgatcctcttgccttggccacccaaagttctgggattacaggcaccgcagccagctgactttaacgtttttaagaggagctttaggttcacagcaaaactgagcagaagattcagaacctcaagactagttttcaccaatgaaatgggaacagaagtgatggctgtgactcccaggccctgccctaaagtgccttgcaggtgttcctccaggcacattctctctttcagcttgctggggtggaaatgagcaggacaaacttggaagccatgcactgaggatgtaagtcagggctgctgtccacctaggtgaccgagtgaccaagtaaaggactattgctcctgttgccaatccaacataccacactgaatgcaatgaggtatctttgattgcatcctggaacagaaaaagcatgtaagtaggaaaaaaacacaactgattaaacctcaacaaaatctggtgttaacagtaacccacaaatgtgccatggcaatgtaagttgttactatttggtaaaactgaataaagagtagatggggactctctatattatcttcgtaacttttccatgaatctaaatttattccaaaagtaaatgtttattaagaataatttttaggcagggtgtggtggctcacacctgtaaccccagcactttgggaggccgaggcaggtggatcacctgatgtcaggagttcgagaccagcctggccaatatggtgaaaccccatctccactaaaaatacaaaaaattagccgggcatggtggcaggtgcctgtaatcccagctactcaagaggctgaggcaggagaatcacttgaacccaggaggtggaggctgcagtgaaccaagatggtgccaatgtacttccagcctgggcaacaagagtgaaactccatctcaaacaaaaaaaaataaaagagagagagagagagagaaaaaaaacgatttttaaaatagctgtattgagccattgtgcctttgggtctatttattactgcagccacgcctaccctaacaaatgcacttctcttcacctgtaaagctcctagtcacattttaagacttggctttgacattatctccattaagaagcttcctgtgattaccagggggtgaggtactgtacactttcttcctcgatcacacccaagagaagtaactcatagaactgcctatttcccaagccacattgaagtcttccttgagtcagaagccttgtctgcttcacagctacaacattcctcatggtgttcagaaatatttgtccaatgagttaatgccagcctcacctatttgttgtgaacattcactataccaaccagaataaaactgcttcattaactctgaagcactgcacagatgtaggggatgattaatcagttgcaaagtatttattgaacaacagacctgttttataattgtgatatattttcctggtggcctggagtgtatgcattgatacatggcacttggtctcatgattctgactgtcttaattagtattgatgaggcaaaatggcttaaatagtcaattcaatgccatctgttgaacacccaaagaccaaagacattataggtgtgggtttgcttttttttgctttttttttttttggagacggagtcttgctctgtcacccaggctggagtgcagtgacacgatcttggctcactgcaaccgccgcctcctgggttcaagcaattccctgcctcaggctcccgagtagctgggattacatgcacccaccaccatgcccggctaatttttgtatttttagtaaagacagtgtttcaccatcttgggcaagctggttttgaactcctgaccttgtgatctacctgcctctgcctcccaaagtgctgggattacaggcgtgagccaccgcgcccggctgagtttgcgtttcttgaatgcctactggctgccaggcaaacatgtgttgggggctttcactcctattatttcactgaatcccagtagtgaaatactccaacgttggtattattatcctccactttacaggtgagaaaattgaggagcagagagaacaagtgatgtgtttaccactgctcacttcgtaagtggagctaggtctccgaagtccacctataacctgcttcttttcaaaacagcatcttgacatatgattgatcgccaggctgtgctaagaactgtcataaaaataaattcaatttcttccatgcccctctgggttggctctcaaataaaagctgaatgccagaactcaaacaaacttccataaactgaagtccagttgttgaagctgggacttggggtcagaggtgaccctcctggcctacagagagctgtctgagctgctaaacccaggatgcttcaactgtcctggattcatctgggaataagaattatttcggctaggcacggtggctcatgcctgtaatcccagaactttgagaggctgaggtgggtggatcacgaggtcaggagttcaagaccagcctggccaatatggcaaaaccctgtctctattaaaaaatacaaaaactccccaggagtgatagcagatgtctgtagtcccagctacttgggaagctgagcagaagaatcgcttgaacccgggaggtggaggttgcagtgagccgagatcgtgccactgcactccagcctgggcgacagagcaagactccatctcaaaaaaaaaaaaaaaaaaaaaaaaaaaaaaaaaaatatatatatatatatatatatatatatataatttcaactttcatgccatgccagtactgctctaagtattttacacagcatagctcacccaacccttacaaccctaggaggagactactatgattccaatttcaaagatgataaaataggctcagaaatgttagtcaaaagttactgtgagtaaatacttcactatgaaattagatgctcaatgtctcctttcccaatagactgcaagccatttgagggcagggacagtcctgccttattcttcttcgtatctaaagtgtacatcacagagtcctgcacgcagtagctgcataataaataattgttgaataaaggcatgaaatgataaaagtcatacaaaatttggggagccacagaatctctggaaggcctgtaatgaatcaactaatgattgttgctatcacgtgaatatcagccaaatgcctgagtctgcaccctgtctataaactcactcctgcctgctcctctccaccagcctcaccctcaccagtccatgcactttctgagagcacccagggaggcagaactcctagatgccaaatgagaatgggttccattcagagctctctgcaccagagccatgctatgctccaggcagaaagaggcagagggctcttagcctgattctttcacacaagatcacttggccctcagttagcatgacttgtgttcaaggtctcaaaagttcccccaagaagacgtttatcatcatttagccacatttatgagctaaataaatgttcatttatttatttgtgtattcatgttgtatgtcactgatattttgtgctcggttccttacatagcaatagctgactattgcaaactactaagtctatgttacagaagaagacactgaagaccagaaggtttaagtaacttgcccaacattttatagaaagaatgaagctagtatataaatttaggtctgtctctaaagcagacaggcttctgctaccccacatggctccctctgtcctttggaaggacatccagtccttatacctggcaggacagccagtgtgtgtcgccagtgtgtgtcgtcagtgtctggggcatctctcccatctgtacctccttgacagtagcacaaaggtgacccttggacagatgctgtactgagtcaggatgtcacacctggaaacccgccgtgtccctgctgagtaactacccttcactccagagctctcctcggcacataaggatattcctcactttaatgtgtaaatgccattccaaatcagcaaccaaatccaccagccaggggagctccaggtgattaatgcatctctcaggtagtgaaaaccacttaatcttcagctgcaagtttctgactccaccaaacacagatctaatcgcccacaaatgcactgcctgatgggtctttattgcttaattaccaaggtgagaggctcataattaataagccatttactcctacatttagatgtctccagaaaatgtagccaaagattttccaaggaaattcacattatttgtcatctttatatctcttggtacctgaattggtcacctatctcattggtttctaaacttttctgcctacaactaaatatgagagggagagggaaaaaaagagacaggaagaggagagagaagatttcccctcttcctcctgactctatttttcatttataaagacccttgtgatacattgggcccacctgaataatccaagctaatcttcccatcacaagatctttaacttaattgctttaattaacttaattaacttaatctataaagtccttttttgcagtgtaaggcaacatattcacagattctggggattagaacacggacatagacattttttatcgggggtgggggtgggttattctgcccaccctaatgttcagcactgcaacaacctaagccccccacagaagaaaatggttaaataatctctccccacacattgcatgtgctgccattaaaatgcttataaagaactcttagaacatggcccatgctgatgctgtaatatttggtagaaagctgggcaaatttcaaaagtattacgctttgcataacaagtgtaaaaagcatgaacaatgatgaacaaataagatgacagggaaataataattcctatttattgtacttggtagttgaatcatgtacacttatttgtttctgtctgcatttttctaaataggaaagaaggatagagaagaggaagagagttgaagatgctgcattgctcgaggaagaggccatgagccaaggaatgcgtacagcttccagaagctggaaaaggcaaggaaatggattcgcctctagatactacagaatgcatcctgccaacacatcaattttagcccagtaggatgcatttcagacttctgatctccagaattgtaagataataaatttgtatgatttcaaaccactacgtttgtggtaatttgctacagcagcaagagaaaactaatccaagtgcccttgtgaatgaaactgttcacgtagttcagatttctattacaacagatctctagaagtggaattactggatcagaggatgtgactgttttgagagctcttgactagatgttgccaaactgctatccaagaaggctgaggggcaactttggtagatgatccaggaagaggaccccaacccccactgccccggggcagtcattcacttctttccatcttagtttcccacacccttgtccaagccatgccctcacctcccctggaaagaatgccccagccccttcactggtcttcccacttcgcctcttggcagccacagcttgtgtcccacatatcagccaggagaatctcattaacacctgagttagagcctggtgctctcctgtattcgtttgagctgttataaccacataccatagacagggtaatttattagcaacagaaattcattgctcacagttctggggactgggaagtccaagactgagactccagaatatatgatgtctggcgagggtctgttcctcatagatggtgactttatgcatgctcacagggcagaagaggccgggggctccctcaaacctcttttacatgggcactaatcccgttcatgggggtgggatcctcctgacataattgcttcctaaaggtcccacctcttaataccatcaccatggggtttaagtttcaagatatgaactttggggtggacacaaacgttcagaccatagcacatccttcattgttttcccattactctttgcataaagaaaactatccctgccctggcctctgctggccaccctctggcctcaccacccaccaagaaccctcaccccttaccttctctgctgtggccacatgggtcttcccccagcttccacccacaggccatgctctcatttactccagggccctggcacatgcctggaatgctctcctcacattcttgttggccccaacatctctcccttgtcctttcgagcccatataaaatgcacctttctcaggaaagcccccttcacctctcaggcaaggtccacttctcatgcattcccatactgtattcttctccttcatagcactcatcatgattacaattaattaactttttaattagttgtttagcttttaatcaaagtttggtatctatccaggaacttgcacatagcacaatctctatgaactttcacaaactgaacacacctgtgtaaacaccacctggagcaataaaacattctctgccttctcgggcatcccagaagctcacccatacctcttccagttactaagtcccctaaggcaatgcctaccttgacctctaacactagagataagtttttgtttttttttttttttaacatctaaacacaattgatagccttttttttttttggcatatatgtctccattaaaatataagctccataagagcaggacccatgtctgttttgtttgccatcctattcccaatgtccagcaccttagctcaacaaatatttgtcaaattacagaatgaattaattaacaactaattaatgttgtaggaattgggcaacaaggtgtaggaggtacagtgagcagggtgcccacaggaagatggaagtaagagaaacaaggtgcatctagccaaggaggggccagcaggaaggtcaaaggaatgcccctggctgcacaagcccagcctgcactgggcaaggcaagcaccctggccactaggggccttccacagtggcatgagtccaccccccacccacccaacctccaactccctgcccatgatggtctggataagatacccttcctccatagataggagcttttctggaaggacacaagctgttgagctccagagagggattgtccttggcaataaagagggggcattagacagtgttgtggtgagaataagctggcatctgttggtctcagactgggagaaattgtagcctgtagcccaagtttgaattgaaggacactgactgggtgactaccccatgatctaagttctgatttcaccagatcctgcttgcctccctactttccctccttccttccattcaaacttctgtccacacttatcagagcaggttctcctatgtgggggatgatacaaccccgttatcagcacagtggtctcaaaatggcaagacggaccctttctttctttctttttttttttttttttgagatggagtctcactctgtcacccaggctggagtgcagtggcgcaatctcagctcactgcatgctccgcccctccaggtttaagcacttctctgcctcagcctctggagtagctgggattacaggcccgtgccaccacgcccggttaattttttgtatttttagtagagacggggtttcaccatcttggccaggctggtcttgaactactgacctcgtgatccaccacctcggcctcccaaagtgctgggattacaggcgtgagccaccgcacccagcaagatagactctttctatgcttctgactgagggcagtttgggctcccaagttggagaagcattgagcctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggtaagtgcctgttggagcatctgcatgagttctccctcctgggcctttgtccctagataatctggcaggggcgcactttctctccattaacaattccacccttccctctcctcattttgactcatctcagtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtggactaaggtttagaaagacacaaaggaactaatacgtttacacattttcctgggtaaaagcataagtaaattctcaatcatcttttctttagtatgattattcatttattaatttcttcacttatttattcattctacaagtgtcccctgagctcccaaggggtttctgcccctcaactagctgcttcatccacagagatggctggtacccaattcttgccttaccgtcagatgaggaagacagtccattttgatacagtgtggcaaatgctatcataaatgaatggtcagggacaatgtcagggagtaaaatgagggagagtaaaaatgacaataaagtacacaagaaagttcaggtcaagcagtattttagaaacaagtagacttaacaagctgaaaagaaaacaggccattaccaaggaagagtatatagaggcagttaaaaataaaagtagataggtcaggttaatgtcaacaatcgctataacagaacagtaaagaaacatcaggctctttacaaaattggatcacagaagcataatatggtttgcaaggaaatcaactagcattaaaaagattcactcccccaaaatggccatgcaggtgccagttttggccacacctctgcacaaggcggatgagcaaacctggtgggagggatacatcgcagaagccagcatgaaaggaccaccaggctgtgctgcaggctcttccaagggaggggctaaggggacacagacggagacccaggcatgcaggtttgagaacactggaaggagtgaaacctgttgtttctctcctgacctggatgcaacagagtaaataagatgatactgcagactggggatgtttagctcctctcttaatgaaactgcttcaaagaggtcgggggagtattcccttggcagtgattgtggttaaactgggctaacggtgactgcctagactgctttctccatctagttcggccaccacagagggtcagggctacccagactaccggccagggaggaaggagatcaacagcacggagatgtgtgtgtctcaaattaaaaatggtctggccagatgcaggcactggcatgctcagggagaagcagtctaaccaaacaagagaaaaaccttcagacctgagcaaggctgtgtgtgtgtgtgtgtgtgtgtgtgtgtgtacaggcatacccagtctaaccaaacaagagaaaaaccttcagacctgagcgaggctgtgtgtgtgtgtgtgtgtgtgtgtgtgtgtgtgtgtgtgtgtgtgtaggcatacccacatgtgtgtgaattcccattaggaggtgggacgctagcaaactggaaggcagagcccatctgaccctgagatcctcacactcatgcaaccttaatgccaagacaaactgaatggttgattgtgtcaactctcttgttttagggatgggaaaacaggcccagagtgggaaaaggagttacctcgagtcaaccaggagagtctacgagttgagattaggattgatccctggcctttctggaagcacactaaccagggattcactccttttgcttccaggacacactctattatttaatcctcatctcaatctcccagtgcagggtaaatggagaaaattatctccatgttaagagtataaaagctgaggctcagagacagtaagtatttttctgagggtcacagaactaatcatggtgcagatgtgattgcaatgaaggcctgtttaactccaaagcctttccactgtctcatgttgtctaatagatagccagcaaatgtttcaaacttaacatgtttgaaactgaactgctgatcttccccaataaacctgctccatcgacattcttccccatctcacttggcagcaatctcatccttccagttgcccaggcctagactcctctctttttctcacttccactaccaatccaccagcaaatctgttggctggatcttaaaatatatccagaatcaaaccatttcaaccagctctccctttgcagatgtcaccatctgccctatctcggatctgcaatcgcctcctacagtctattctcagctctgtagctggagtgatcttcttcttatgcaagcaactcatcttactctctgttcagaaccctgcaacagcttcccatttcatgcagagccaaagcctaagcccttacaatggcctttgagtcttgcaagttttttttttttgggggggggtcggtttttattatactttaagttttagggtacatgtgcacaatgtgcacgtttgttacatatgtatacatgtgccatgttggtgtgctgcacccattaactcgtcatttaacattaggtatatcttttaatgctatccctcccccctccccccaccccacaacaggccctggtgtgtgatgttccccttcctgtgtccatgtgttctcattgatcaattcccacctatgagtgagaatatgcggtgtttggttttttgtccttgtgagagtttgctgagaatgatggtttccagcttcatccatgtccctacaaaggacatgaactcatcattttttatgactgcatagtattccatggtgtatatgggccacattttcttaatccagtctatcattgttggacatttgggttggttccaagtctttgctattgtgaatagtgctgcaataaacatgcgtgtgcatgtgtctttatagcagcatgatttataatcctttgggtaaatacccagtaatggcatggctgggtcaaatggtatttccagttctagatccctgaggaatcaccacactgtcttccacaatggttgaactagtttacagtcccaccaacagtgaaaaagtgttcctatttctccacatcctctccagcacctgttgtttcctgactttttaatgatggccattctaactggtgtgagatggtatctcattgaggttttgatttgcatttctctgatggccagtgatgatgagcatttttttcatgtcttttggctgcaaaaatgtcttcttttaagaagtgtctgttcatatcgtttgcccacttgttgatggggttgtttgttttttcttgtaaatttgagttcattgtaaattctcgatattagccttttgtcagatgagtagattacaaaaattttctcccattctgtaggttgcctgttcactctgatggtagtttcttttgctatgcagaagctctttagtttaattagatcccatttctcaattttggcttttgttgccgttgcttttggtgttttagtcatgaagtccttgcccatgcctatgtcctgaatggtaatgcctaggttttctcctagggtttttatggctttaggtctaacatgtaagtctttaatccatcttgaattaatttttctattaggtgtaaggaagggatccagtttcagctttctacatatggctagccagttttcccagcaccatctattaaatagggaatcctttccccattgcttgtttttctcaggtttgtcaaagatcagatagttgtagatatatggcattattgctgaggtctctgttctgttccattggtctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaggaaagtcattggtagcttgatggggatggcattgaatctgtaaattaccttgggcagtatggccattttcacgatattgattcttcctatccatgagcatggaatgttcttccatttgtttgtatcctcttttatttcattgagcagtggtttgtagttctccttgaagaggtccttcacatcctttgtaagttggattcctaggtattttattctctttgaagcaattgtgaatgggaattcactcatgatttggctctctgtttgtctgttattgatgtataagaatgcttgggatttttgcccattgattttgtatcctgagactttgctgaagttgcttatcaactaaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccgagtcttgcaagttcttgtctccaggtacattcctgacttactctcctcccattttctccttcacacactcagctctaggccccctagcttccttgctgttctttgaacattacaagcatgctcctgcctcagggcctttgcaatggctggccgtatactagaaagtcttccctcctcccttcttcctccacccttcatgatccacgcgactaaatctctctcatctctttcaagtctttgtcaatatatcacttcctcaatgaggcctactctttaaaattattaaccacttctactgcaagaatttccaatctgcattctctctgctgcgttttctcttactaccttttagcataccatgaactctactcatttattatgctaattggttattttctgtctcccacatgaaaatgtaagcaccatgacggaaacgatttgtttcttttgtttattggtgcatccaaacctagtaagcagctgacacatggcaggtgctcaatgaatatctattgaattgcactatctctctaattggtggctgcataaaaaaaaaaaaaaaaggcttaaactcacaggagaggaaatttttctaagtcacaaagtcatttttttaaacattactccatccctaagtcttccacagaaggagctgaatgtgtaattttgacaaatgagtttgcatagagaaggaaataaaacatggaatgagactatgaaaggagttcttgggaagagaaaattgcattgcctttaagtaggaaaaggaaagtaatatttaaaagcaaagatgtttaaaacatcgcaattgtaggtagaaataactcagaggttgaagggggagggtgctgcaagatgcagtggaattctttcttatctgggctcctgcctaaagcattactgggcaattgacaggccaaatcaataagcaacttaaattctggtctaaaggaataactgaaatgaatgcacaacagcacagggaaacaaatcggcacttggaacaaaaaaggggctggaatgctggctttgactggcttgttcaccccagtgaaaccagcactccaggttacttgctaagtgctgtgatgattataataatggtggctttgtggggagagtgtcagcgcagccctctttccctcctgggtcccagtagatggatctgaatctggtctgttctgtggagagaagagaggagggaagcacctgtcttggtcttgtctgcaggctccctttcctggggtgtgaaggagctcctgcaggcttggtgtggagggctggtcccaaaggcaaggcctggggtggaggcccctggggagaagagaatgaacctcaaactcagggttggccagacgaagctctgaggctagaggtggaatcacaggctggaacacactgtccagaattcagatggacagagacaggatcacagcaggtcaccaacgaactggaaaaatccaagccacctgggctgccacctatagttgtgcacaaaaccacaggtcaagggggtgagtccgcctgaaattaaattagcctaggggccactatccctcacgtgggttgagccagttcagagggagggacatctttttgcaatctgttcacaaaaagaggttaccttttcaaaatttgcacagagactccccaaactctggcaactgtggttatctgtgatcaccctttagtggtttgttttgtagagtcaggcatgctctggtcaagagaagctgcaggaactggaagaaattaactctgatcttctcagagctcgcccaaaaaactggacctatagagaaacctatggaacatttcaggcttccttttcccaatccaaatttgagctacagatttgagccccaaattaatccccaaatggttctcctactgattcgttcatttcgttcatccaggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgcacctgtcaaataaaaacataagcgcctccaaattgcattataaatgcacaatactttttggaaacagtttgcttcagaactttggcagccacaataataacacacacaagcctgtttcaccccaaaggaaatatctacaatacaaggatgtttagctccatcatttttcactgctttgggtttcttgcaaaaccattttgatttcagttgaaactaatgacagcaagcagtttatggtcaggttcacaaagtacatttctacccctgctgtggggaagggatcacaagaaaatagcttccagtaggttacgactcatctagctcccaaagtggggactcctccaccagagcctgcattttccactttttgccacactcagagaaggacttcgacctcaacatgtgatccagataaagagcatcctcctacacaacctcaaggtaataataacattttattggtatcttgtacatccgttggcattggcatttatatttttattcctatatcttcttatgtcaaagagagcatgctatacatcctgttcccaccttgcttttctcttaatgatttatttgaaaatggtttgtcattcatttctacagctgaataatagtttgctggatggctataccccatgtatataacccgagacagggtgaccttttgtggcccactgcctggcacttggcttggtctaacaaacagaaccttcatgcaccaagctggtcatgccaccaagtcagcgcagtcattgggagtgagtggtatgtgagtcctggctccctgaatgccctgatggaccccatggtccagccacactggctgggtccctgtaagcttagcctaccttgcctgagagccaaggaaatcccatcttctgcctcaccatcctcaaccacatttcagcaccaatgcaagatccagtacagctgctggaatccttgtttcatccagggtggacatggcagaggagtcagcaaccattttgtgccccagtgttcttcagataagttcccactcatgacaaactctagcccatactgcaactgaggtcccaaacatgcaattgcattgtttcccacggtgggctgggtcacttgctactgcaacaaggcagaggaaggacagcatcccagcatttacagacacattgcccagcatggggtctggctctgccagaatccaccgaaaggtatgagccctttatgaactagctgcactctgccctttggtcataagataaactcatatcttgacccaaggcagagccctgacatcagcatcagatcaaacttttgtctcaccacagagcaagccctgaccctggtcagactcaactctgacccttgcacggcctgagccctgacttgggccacggactgcaacccgaccctcagactcacgctgagtcatgacccagatcacagacacagctccaagccccagacttatcctgagccctaaccctgggcccagactcagccctcaccttggctgtgactgagcccagctggctatcttcaaatgcggtcacacaggaggtacttggcacagtaggcagatggctctgtgtgagccctgcctcggctctggatggtgcttatgatctactgcctatcacgagcatctagtatcttgccatggggaagaaatctcagtcccacagacctgagttcaaattctgccactgtttagctgggtgactttgggcaaattacttctagtccatcaaattagatgccttctgaagaaaccatttataaaatgggcacaaaatacctgctgtcatgatggtcatgattaaattatatgattgtaaagtacccagctcacagtagatagagttcatccctttccccagtaggcatcttgtcagctgcagctgaattattggtataggaacaagccctccagagctgtgctgtcctatactgtggccaccaaccatatggggctattttaaacaattgaaatgtggctggtacagccgggcacagtggctcatgcctgtaatcccagcactgtgggaggctaaggtgggtggatcacttgaggttaggagcttaagaccagtctggtcaacacggtgaaatgccgtctctactaaaaatacaaaaattagccaggcgtggtggtgcacgccagtaatcccagctactcaggaggctgaggcaggagaatcacctgaacctgggaggtgaaggttgcagtcagctgagactgttttgtgccactatacccagcctgggcaacagagccaaactgtccccaaaaaaaaagcaaataaatcaaccaaccagaaaaatgaaatgtggctggtgcaaactgagctctgctataaggaacacaccatatttcaaagacaaaaaaattcagaataagaaaaagaatgtaaaatgtatcattaataagtttttaatgattatgcatttaaataatatttgaaatatattagatcaaataaaatatactactagaattaattgcacctggttcctatttttaaaaatatagctactagaaaattttaaattacatatatggtttgcaggtccagaggtctgggaagagcagttcatgggtaataaagacagttaaaacagaaacaagagcaacagtaaaattaatacctaactaagtgtttattgtgtgctgggcacggcactaaacacttaagtcctcacagcaacctctgaaggtaggccctactactgtccccattattgagatggcacaactgaggcaccaagacgtaaagttatatggtccaaggtaaagagccagtaaaaggcagaaataggatttgagtccacaacacctggatccagaacctatgtcctagaggaaatgacacattcattaaaggctgcctcagtaaagtgcttcctacaaatgagtcacccacagggaagaaacatgccctggatcaattaaatgctgtcattgagacatgggcagcagcgaaccccactctccaagctcttacctacccacattgctaggcacttcactgcccatcagactggttggcactcaacagggtctttatggaggtgggggagttctctcatttaatcttgtgcatttctcagacatatgccaagttatctttatctggagaatcaaagaggacagctccttcaaacctttttagctttctccattagcaagaggtacctctgagagcaaaaatgataaactcaattgttcaaaaagcaagttccgttcttcaatttgtgtgccagtcataaacacagcaacttccatttgagcagaaatcccacatttcagcagaaatacttaatgtgtcatttctcctgcatccatcttcttcaaagcacttactttagaaagtagagaaggaaaaacaaactctaataacctgtactttgaatgggagatgggaactttatgataaagaactcaaaatgctttattgacatggctgcacacatcccccttcagctcctgaaactgctcctgagatgagaaaactttcctaggagccttgcaactcgacttcacacccagctaggctctgggggtaggatgcacactcactccagctcctgatctgttttgatcagccagaagtcctagttcaagtctaaacccagaatataaccatcttttttatcttaaatcatgcatttacaaatatctggcaaatacatattgagcactgtggcagattatattttccaaagatggtcatgaccacgccacttatcccacaagttcttacaatgtgatcttgtcactccccaccaggaggtggagtttatgtcccctcctctgggacctgcgtggacctttgtgatgggctggaccaatggagtatggagaacaggcttctatgtgacttctgaagctaaacataaaagttacaacaagtcatgaaagagaaaagcttttgctcttggagcccagccactatgctgggaggaagcccaagccacatgaagaggtcagagataggtgttccagctaacagccccagttgaggcccccaggtggcagccagcattaacctccagacttgtgagtgaggagtctggcttatatataactccagctctagccactgtcttatgcaaccacaggaaggagcccccaaatgaagccacctacctgagctagttatggttcatcaaaaaaataagacataatgaaaaatacattactgtcttatgccactaaggttctggtgacttagcatgcagcaatagataactggagcaagcacctactatgtgccaggcattgtgcaatctgctttaacaacagttgaagcagactttgtccctgaccttaaggagaccatagcttagtggggacataaaaaagtaaccaatcacaagcctgcactgtatgaacaggtgacagaggggcatgcaagatactttgggaacaaaccaggcttcgggaatgtaacaaggcctgaggacatcagggaagcatcctcagaggagaagattgtttaattgagtcttcagaaggagtcagtgtcaattagatgaaggaaaacagagcttttcattcattctaaggaattttgggaaaataatgtagcaaaaatagatagaaaaaactatgagaaagcctgctcacttaaaaacatattataaaacctcaataatcaatacattaataattaaaacctcgataattgattggcttattgacagaccatttgactaatgaaacatcaaaaagtgcagaaatagatctaaatgttacagagatttagcgtgtgtgtgtgtgtgtgtgtgtgtgtgtgtgtgtgtgtgtgtgtgtgtaatggggcattccaaagagggacttttccagaaatgcattgtactgcatgctatatacaccaagataatatccaaatgggtcaagattttaaatgcaaaaagaaatcccaatccactgaaattttagaagaaaatacagaaaaatagaattttagaaagaaaataattttgtataactttggaagtatctaaagtcttttttaaatcaaaatccagaaatattaagggaaagattgataaatttgactacatgataaaaaaaaattgtgtaatgccaaaagaaaaagagagggaaagagaagccttaagctaagtctaaaaacaaagacttctatgaaggttgaagataggtacaatgtcaacctgaaaaactgcagcttctccttagcaatcctaagatatctatagcttcttgaacctcttacagagggcctgaaacagagtagatgtttaataagatatattgcatgatcctgttacagaaactctcactaagatggaagttctggtttaatcttgactcagttatgtgacctggaacataaatgggtatgtgcacacacatgtgttccatgcactggggggaagtagagcaggtgattgcttccctactgccctaccacctcattcctggaaaaaacacatcaccactttcaaggtaatacattgacgcagtgatcaagactgccaggcaaggccacagaggcagcattaaagcaagcccaagaatcaggcattgttctatggatctcactgttcccctaacctgaggctcacttcttcaaaagtcaggatctggctgcatcttgctgaacctcaattttcccatcagtacagtaaaatgggcacaatgaccatggcttcagaaaccagttgagcatttaaatgagaataatgtatataagagaccgagcactggtggaggatatagcacaaacttcgttcttagtctctgtggccaccagagtcattatggtcatggtcagtttgctggagattcttttttttttttttttttttttgacatggagtctcactctgttgcccaggctggagtgcagtggcacgatctcagctcactgcaagctctgcctcctgggttcacgccattctcctgcctcagcctcccgagtagctgggactacaggcacccacaaccacacccagctaatttttttttttttttgagacgggtttcaccgtgttagccaggatgttctcgatctcctgacctcgtgatcctcccgcctcagcctcccaaagtgctgggattacaggcatgagccaccgcacccagctttgctggagattctattacgataaatatgtaggccaggcgccgactggataaataggcaacctccacttgtgcttctctgtctggaggagtttcttgcctttaaggtacattgcatagatgaacagaacacattaccaaagatgcacaggaacaaaatgaaagcatcaagaacaccctgacctgctactcaggatactgggccataggccccactctcatgatttcaggctgagagataaggagctgttaaagctggggttttgtttctcattcctccctaaacacagtgaagcttgggaggcattaaatggatcaagcatttttcagaacaaggtagagaaaaaaagacgtggaggtatgtcatgcttagaaaacacaaggctagcccctctgaaggtgctgaccgactccctggagtttactatttgtgtagaccttacaaagctcaagtttggggtgtctgcctgtcagtttctgcttcctggtttccatcatgaggcctctgaggactccacctaaccatgttatccagtccctgccactttaaatcaaggatctgaaaggcagcctctccatttagctgacaggagaggcagctttcaagagtcttctgtatcctttgtcagtgaaagtcacatgggggaataacccaaacttttcttccctttccagtgtagtgaaatggtaagtttcaagcatatgaaaaactcagccattggaacatcatggggtcgattaagccagtaatgactcaaaccaaagagctggggaatcttccgactaagtaatagggtagtgaatgcacagaaaggcagaggcaaaaaccgaattgtagcatctagttcatgagcctttgcatgactttggtctcaacaccggcacagtaatcatcatggaatctcagaatcactggaggagcaggatcccccaaaacccatctctgtgatcgctattggatgccaaaatcctccgcacatcttcatctagtggtcacccagcctctgatagcctccaggcttgaaactctactctgaaatattaagaagggaagctgtgttcaccactcagacacccactcctatttcacctccctgaagaaaccttccctgtctgccctctcagtcactctctaataccttgtctgactttgccttcttaatagatgtgttaggtgctgacccaggcatggaggttctgactgtgatgtcatgtagcttacttattgccatttagactgagctggcgagctcatttatctaatctgttaaaaccagatttggtggaaagtgaggacctcaatatttccacatttgctgacaaccttaaactctcatcgaagagtgggaagttgttgcttggaatcacattaagattaataatgacaatagagataatgacaactgcaaatatagcaactctcccactcacaatggcagtcccgattgcacaaagaatccagtaccaggaagggacacattttaagctatcttggaactgtttcctaatctgtgggataaagatagatcaaacaccactttgcattttttaaaccttgaataaataggtaaatagcccctttgttaagtaggagaaaatattgggaggagacgagtttaggcttctcaatatgtttccatctcattggccagcaggtctatggttcagagagaggttgaagctggagacagggatttcagaattatctgtagagtctcttggttgaggccttgggaattaatgaaattgcagtaccagagagtaccggaggagaagggaagtggggagctgtcctagagaacaagctagaatagaaacagtcaagacagccaaagcaggagtatccggagaccaacgtgaagggaaagaagtgagagacatgtggaagaggtggcaactcctgccaaaggggattaagaacaaggagttctaagaactttctgcagggctgttggttggagacgctgcctccatgcaaatctcatttgccgctgtcaatccagatcctgtcccaccacgaccatttctgagaaacagactcaagacatgaaaaaaaaccctctttctgtaaaattggttcgtgaaacagactacaggcattaatatcctttatgagtgacaatttagggccaatatttacactttgtaatgttcgttctctttctctcgggacagaaaagaatgttgccaatatcaatgaataaacattaataaaatcaaatataatcttgttccatctggaatcaacctttaaaaaaattcttaacatctgtatataatatacatacacctctatgtacaatagggaaatcagattttgcctgagagatgtgcacagtatttaatgccaatttatttggttccaccttttctccagactgctttagaagggtagcgtccctagaattgagattctgaattagtttcctctgactctcaggtacagaatgtccagctcaagccaagacatatcaaatatttatccactcccagattttcaaaaatccagctttctgtctcctcctgcagctgacctcctctggcagaaattcagcctcaaactgggagaaatgagtggatcaccagaatcaaagctgacgtcagtggtactgtgggttggtgtatgacgtgggaaccctgacaaacagaaatgaatgtttataaatgttagatctcaggtctgcaaggaaagatcttgctgtacttcacaaatggacttgctttttaatatgtctcctgtttcaggacaagtaatgttggtcagaactctgggggtgaacctaggggctcgtaccacttggggctgcgttgtcactcctgtcctcagcatcgcagaggccaaactgtacccagatgagaccccagggaaagagaaaagaatcttgggcacgggggtcattattcaaagaacctggtgtagtgcgtgggagatactgcatgcacctctaactcagacatatcattaattcacaccatccctcttgtgcctactaaaccaggatttctcagcctcaccaccattgacattttgggccagaaaattcttttcttgtggaactgctcagtgcactgtaggatgtttagaagcatccctggcctctacccagaagatgccagtagtactgtcccggttgtgacaagcagaaatgggtccagatacggtcaaatgtcctctggtgagagggtagcaaaatggcccctggttaagaactactgcagtgaattattcaagggaccatgagtgaagttttgaataatccacacctgagctaagtggtgccagagagatacttgcaggacctcagctttgttagtctgacatctctcctataagcccaccgactggagaccccaagcatgctgcagcccctacctaacagatcttcatttattccattacaggctgtgggcagcatttcttcatttcagatagaatcttccagagtttaggaacagagcaggctgccttctctcctcttgccaggaatttcagtgcgacattgaacatgtcactggagtttgcttgttgcaaggacaaacacttctcctggcacctcacccccacacctgcctagagacaaggctgcccaggctgtttaaagggaaatcagtactgtgccaggcctgtccaagtgaattttttctttgagcaaatacccctgcctacttgttcatttttaaaaccataggtcttcctggtgagggggcttcaaataaactacaacaaagagtaaagtctttatcccttagtaggaagagaagaagagcctccaacaataatttattcattcatccactggtaataaaggcagggctgtgatcacaagagaggagatacagacttcttggtctcaggggatttgcaaggcccagagtgtccagtggtatagatctatcaaggagaagcttccttggtaaacttagtgcctactgatccaggaaggaatatgtgctgctcacttcatccctctgtctccatgtcccacctggtaaaaatcagtcctgacaataccaaaactttgccaattctacttctgaaatatctcctggctcagatccctccatctttgcagttcctaacgtattaatagttcaggtatcatcttcgtttgttcctctgaactaatgtaattgctttctcatgcctttccttcccacttccatacggaataccacggcggtctttgtaaaacccaacagaatgagaaaacgctcatatccctcctcaccaaataccataaacaatgtttgaaaataaaaacaaaattgtcacgtggaagaaacaaaaacacttgcaatgtttgtaacagaaaacctaatatctatatttctgactctctcctggcttccacatatgtgaagaactctcacaaatcagtaagaaaatgccaaaaataggcaaaggccatgattaagcaaataccaaaaatgaatttttaaaacgaaaaatacaaatatgagaaatgtgcaaccttacttctaattgagggccacaaattaaacaagtatattttaacctcttagattagcaaaaatgtaagaggttggcaacagcaggtgttgacaaaaattcacaaaaatgggagctctcataatggttggaagtgtaaattggtgtataatttatcaaaggcaattttcctacattgtgtttgttttctactgctacataacaaataactataaatttagtggcttaaaacaacacacattcattttctcacagttttagtgggtcaggagtccaggcagaacttaactgggttctccgctcaaggtcccacaaagctgcaatggaggtgtcagccagggcttagatctcatcttaggctgagtcttcttccaagcgcacataattattggcaaaattcatttccttgcagctgcagactttttgaggcttgcttcttccaggctagcaggaaagagggtctctgacttccagactcttttaaaatgtctcagttgattaggtcaggaccactcaaaattaactctgttgattaaagtcatctgattagaaaccttagttttatcccaaaatcccctcacttttaccatatattgaaacatattcacaggattgacacccattgcctttgccatattctatggcgatatggtttggatctgtgtccccgcccaaatctcatgtttacttgtaatcccaatgttggaagcagacccagtgggaggtgactggatcatggaggcagagttctcatgaatggtttaacatcatcttcccttggtactgcatagtgagtgagttctcacaagacctgattgtttagaagtgtctagcacctcctccaacctctctttctcctgctctggccatgtaagatttgcatgcttccccttaattccgccataattttaagtttcctgagatctcctcagaagccagactgatgctgccatgcttcctgtacagcctgtggaacagtgaggcaatcgaacctcttttctttataaattacccagtctcaggtatttctttatagcagggtgagaacagagtaatgcatatgggttagaagcaagtcacaagttccacccatgcccaaagggaggggattaaagaaagacacagatcatcagagatcatcttataattctgccaacagcatatatagaccaaaacttaaaatgtttacaatctttgccatagtaatctcacttgtaggactatatcccaaagaattaagtggactagaacatatatatgcccacagaagccttttcatcattctgctatttgaaatcatgaatatatatactatagtagcaaccccaatatccataaaaatgagttcaaataatttatgatatatgcacatggcctatcgtatagctgttaaaaaaaaacacaagtgatcaaaaggtatttaagtaaaaagagtgctatgatgtattaagaggaaatagcaagtttaagtccatctacacttatatttatatataactgtgaaaatgaacctaaaattgtaaaataacatacagctattagcagacagtatcttcaggtatgggaatagatggcaatctttattttctgtgtagtttttatggtgtgaaactttttgaaatagctgtgtattccttttataacaagacacaacaaaagagctgttttttaaatgcgagagtattggtttgtaaaatgagtagtgtacaaaatagtatactcaagggcatcttatgttttgtaaaatatagatgagaagaagaaaacttgttagggaagacacaaaattttaatagaggctagatagacgttggtattatgggatgtcttgaggttctattttagctgttttctgcatttttccaatacaacatgtacattattttcatagtttttcaaaccaattcctgctatcttttttttaagtgtagaaaaggaaccatacatagggaaaaaaaaaatagccaaatgcagtctcacttccctggtctccaggcagagatggcctccaacatctgagcactcactgaccacagcttcctcccatggcttaacagtgccttctattgtggctgcctcgcccatcaggctgtaagggtactgatggcagcacccctcgttcacctctgcacctccagtgcctgtcacagggcctgccacagagtacttcacggcggctaaataaacgaatgaagaagatactggcaggctagaaccttgtaagcaaatcaaagtgttccaacaatcatcttatttgcaatggtgaaggatggagttgagggagcaaactggaggcagggagacaagatgccctggtttattaggagtaagatattgaggacctggtggcaagggagcagcagtgcagatgcaccggaagtggaaaggacagaattcagggaataatgggagtaagtgtccacagcagccaagcattgagggtaatgcccatactctggcttggacaactgggtggtgacatttgcctgaatatggagcaaaagcttttgagagagaaaacatgacaacttcaggtttgaacacacagggtttgatgagcagagacatctgggaggtgccacaaggagctccttatgtcatcctcccagctgtcaccacacacagggttgattctgcaaaccaccggagcttaattgatgcatgtcttctgagtaaaattcatctatccctcctcagggatgaaatgccccctgccttaggattctgtgacttcctcaagcccagagagatggggtgcaatgggagggttgagttacagtgtcaggcactgcataggctaaggagctccagggtctgctactctgctatctgggaagatgctcatttgcattggttccctctgcagtgggatgattttgtccttcatttgccttccctggatgatgcaggctgcctgcatccccactctgaaaactctttacacagaactggccgcacatttcataaagccatgagtgatgtcaaagagcatgtacaatggggagaagactgactctgggcattaattttacatttgtaatcaggggatcttaatcaaatgccaccaagctaccattgcaagacagccttccacaaacaccaccccttgcacagctcaggttctgcctggcactcaaattatctgcaaaatggtccctaccaccgtgcccacttatgccccaggcctctccatggagccacatccagtttcctaagcttactacatcactctttgtgttgtcctctcagccttgattgcccttccagatgtaacctaactagttcagccctctgcagccttcaaaacctagctcagtcatcatctgtcctgggggatctttcatttttattttttaaaattttacttattttggtttttgttgttgttgttatttttttgttttgttttgttttgagatggagtctcactctgtcacccccactggagttcagtggcactatctcaactcactgtaacctctgcctctcaggttcatgcaattccctttcctcagcctcctgaatagctgggactacaggtgtgcgccataaagtctggctaatttttgtatttttagtagagacggggtttcaccgcgttggcgaagctggtcttgaactcctgacttcaagtgatctgcctgcattggcctcccaaagtgctgggattacaggtgtgagctaccacacctggctgggattttttattattattattttttacatttttaattttatagatttaaaggtacaattgtagttgtgttaaatggatatattgtacagtagtgaagttggcttttagcgtccatatcaccggatagtgtacattgcgccgataggtagtatttcatctctgaccctgctcccaccctcctaccttttagggtttccaatgtctcttattccactctgtacgcctgtgtgaacccgttatttagctaccagttataagtgagagcatttttgactttatgtgcctgagtcatttcatttaaaacaattgcctccagttccaaccatgttgttgcaaaatacatacttttattcttttatggccgaatagagttccatggtatatatgcaacacattttctttatccagtcctctgttaacggacactaaggttggtttcatgattttgctattgtgaataataccacaaggaatatgtgagtacacctcctggcaatcttcaacccctttctaacagggtgggtttggatccctctgtcctgagtcaatgtcaaggcactgcattgaacctttctgtttatgattctgcatctctcacactactctgagttcgtaggttgctgtgccttgtctcagtaccatgctcagctccatccccacatctaccatgttatgtactagtgagtggtagctcccgcctgatagaatgagctactctccatagtggaaaattctttcccattgattccaaacagtgcaaaagaccccctttcagaatgaaatttgagggtcacctttggctcttctctgctgcatctccaacatacaatctgccttctacctgcaccatcacccctttcattttcccattatattattccagtggatgcaagtgattgcaaattaccatctcacccgtcacaaaagcattatctacaaatcgctttgtaggccatcaagcatcagcacatgtcacgattatctgggtgctcataaaatccttgtgagatttgaaggccagaaaccatcttccacattttacacacaagaaacatgaggctcagtaaattaatctagtcagatacaaagtttagactgcaaatcaagacttgtaattctcagacttggtctttttacatgttacctccattaaatagtctactataagagttcgttagggatggtttactctacaagaaaaggatccttttgtttttctccagtgcctagtttgggacgcagcacaacaaatcaataaatcaataaatcattactaaattaatgaatacatctcaataaatcattactaaattaatgaataaataaatgtccctttgcatcatgaccttagttttctcatctgtaaacgagcatgtttaggtgtgctggttcccaagaacatctctggcactcttttgtctctagctatcaatttctggctagcagactgactgtcaggcggaggtctgtgccgggcaggatgcaggcatggtgaacaccaggtgccctgggtgtgaataacaagcaacaaaaactgaactgagaccatttatgaaaataataatgaaaccacacattccttgataccagaaataatacagggctccatgccttgttaccggctctgcttctcaatgtctttgccatcccaatgtcgttcattcccactttgcctgaagtccatttttggtacagaaatgtaatttagtgggtggcttttcccacaactctgggccactaacacattcattttcttctctgcttttaaagtttatgttcctttgtgcacaacaggcagcacatcaccactttcctgcaaagtcacaggcaacagagaaactcctaaaagctcctgcaagtcttgggagagactggagcatttccattaagaccctcatgctactagattgttcttaggaacccctcagaagattcagcaacatgcaaagtgacttgtagaatgggataataatcataagggtaataaacgcctatttgatagtgcttactttctgccggacactggtcaaacggctttctatatatcctttcatttaactctcctgacaactctgtgagggaaatgctgtcaatatctctatgtttcagaggggagatctgaggcatagtgacattaggacactctacaggtcacattattaggaatgggcaaagccaagcttggaacccaggcagcatgattccagagcaaatactcttaccactatgttctttttttctcctatagctacatatgctcctctttcatgaagccttcctggccaccccacaaacaatgctaaatactagatggtgacagaacaaggagcaggggcttcacagtcagttagaactgatttccacccctggctgtgccaaattacttatatgattgtgggcaaattgaataacctctttaaatcttaacttcctcatttgtaaaatggaaatgataaacatttcacagtaccttggcaaacacttaagacttaagagtcagtaaatgtcctgcatgctctgaaatgggaagtcccaaggcagaacagaggggtgctctgttcccttcactcctcattcatttattcatttattcacttacccaacaattctttaatgagcaccaaccacataccgtgcattgcctggggtcctgggaaggttcctgttctcacggagcttacagtctagtgatgagtgacagaagttaaaaggcaaatacaccaatggcacacacaatttcagagacaatcagcgcaagaagacaataaacaggagatacgagtgatgtagtaatggtatgctggggaggagggtgtgagggagagaactgctttagactggcctgggagatatttgagccgagactaaaatgagcaaatgagcagcatcagccagccaagtgaagatccagggggctaggggtggggtggagaggggacaaacgatttagacaaaggaaatgacaagtgcaaaacgcaaacaggcaaaaaacttagagggttctaggaaaccaaataaggccagtacggctggagcatagtgcatggccaggagaatagaaggagatgagctttgagaggctggtgcgactagatcttgctgggccttgtgggccatataaacaaggagttcggatttcattgtaagtgcaataggaagctcttagggcattttaagtagggaactggcatgatgtgatttatgttttcagaagctcaatctcgataagaagtgaagaatggataaaaggagtggaatacatttagaagtggaacctggagattgtgataaatgttagacctcaaagcttcactccatagacggacaagaatgacatttcttctttatccccgtagatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaataaatgcctgtcacatttgatactcatctgaattactgatgttgggcatgagatggtggggccatgcgatccctctggagacaggaatctggtttatttggatccccaggagctcatgaatactgtgagttaggcttttggctcttaaagaagagagtccataatatcccagaacaatgcctcagtagcagatttagttctcttttttttttctcctgattgtgttcctttttacctagcactaatgtgggtggctatggtgagagaagaacatgctaggaagaggttctctcattttcatattcttctcatgcacacatccactagggagctaggtggagatgcttgcaccccaagagctctgggcccagccactcattggaatcaataagccttcctaagggtttagagttgggggaactgaggcccagtgatgttctatatctctcttctataccccgaagacattgagttccataattgtaccatactttgcctggcatggcctgcactggcatggctcatgaaacatgataggggcctgcccagttgacccaggccccccttgaggcttggtgtgtgctgagagggtgactcctgtttcaggcattgacaagaaacccagtccaggggtttgtgttgctgacagcaggcaagctatcagcaggggtgtctgatataggctgtgagactccaaggtcaaaggaggaaaagcatctcagagtctctgtcggttggagagggcagagatgaaagtagaactcatggagtgaggcgtgacccaagcactacagggagaggcacatgcaaggcacaggcctctatgaatgcctgaggagtccattcagaatccagttagacctgccccggagcaggtgaaggtgggtcacgtggtcagagctggacccatggctgaatccattcagccactttctgctcaggccaggactgaccccaggacacagcctgcagtaggggagctcactgcccttgcttaggggcaggcaaagagattcaaaagccaaggggggcctggtaacactgacatcccaggctcagttctgctcatcagtccctgagtgagaaaagctgcaggtcttcaggcccttgtcactccctgctggtgttaatttactcacttcttagacgtctccgcagaaaggtcaagggctagatgagtaatcatggctgagctaatgcctcagcctcagccatcgattctcgacctcaattttcacaaatgtctcactatcttatccaaatatgcttcataccttggaggaaagggtgttcctggtgaagtttgcaaatgattgatttaagtggttgtggctttcagaaactggcataaaaaagaatgtgagcaaagaccgatctgcacaggaaccaaccattggatgctgctgtggggaggaatgtggataccaggaaacgggctctctccccctcctacaggagcccagagcctcctacctcagtccaccgattagagggtcacaggtttcaggatgcatcagaattacctggagaatgtgtcaacatgcaggttccagggccctggccctagagtcagattctatagatgtggcgcaagacccagaaatgtcatgtggccacgatccttcatgagcctgatggaggcatggtctcagagccttgctgctcaaagtgtggttggtggactgcaggcagtagaacagaaatgaagaatttcaggctacaggatcagaatctgcctttaacagaatcgccagtgattcttgtgcacgatgttgagaaatgctggcttagaccacattgtgagccccgttggctcttctctgggcccagatttttctctggctgtgttttgtgactccacttcactcacctctaattccctgagggaccccttccaccccaagataaatagaactgaccttctgggccacacactcttgcagggagacatgtacacacacacaggcacctaccaaggctgatgtggtagggccagcccagcagatctgggacctcagcaaagccaatctgagggcaagagaatgagaacagaaaaagtatgggggctacagccttgccaactgctcacagatttcagcaaagaaaacagcaataattaattctgccaatactttttgagcacctgctatgtgccaggccctgggggaatgacagccgccattcatataataccttttggttgataaaacatgttcactccattctgtcagtgaactgcacatacgacagagaaatgagcctgtgatatagaaagcatgatccccattttacagatgatgaaactgaggctccaagaaactgagttacttgtccaagatttaaaaatagcttttgagctgggatccccacttttttggctttcttccctcacactcaatgtgattaatttatttgctctacatggtcatttgagcattacccccgacatttttttctgccttttctgccatgatgactgtccagcatggagaagcattgtgtccagttgccactgaatttccattagatggggccactcatcctgaactacaagtggcactgagtatgcccatgctcacagcagctattcatcatagctaaattttcatcacagctaaaatgtggaagcaacccaagtgctcatggatgaatgaatgaataattaaaatgtggcacatacatagaataaaatattatttagccttaaaaaggaaggaaattcttacacatgctactacatagattagccttaagctaattgaaataagtcaatcgcaaaaagagaaatattatataattctacttacatgagacacttaagagtagtcaaaatcatagagacaggaagtagaatggtggctaccagggggtgggagaagagggaaatgaagagttcgtatttaatggacacagagtctccattttgcaagaaaaagagttttggagatggatggtgtgaaggttgcacattatcaatgtatttaacgctactcaactctacatttaaaaatgattaagatggtatattttatgttacctgtattttaccacaatttaaaaaaatgggaggtggaggaagagattctaagcagcttcctgtgtaaaggccagatcttggaactggaagttaggactgagccaccaatcatgaacggaatgaccactgggactgcacagaaatatattaatatgtcagccaaacccaagattcagaggctgagcagggatacgcaagacattgctttgaagtgttgattccttatcactcatcagtgaaaattcttaaacttggagcaacaatgaaatgcttcctgaacacaagaaaataaaacaacaaaataaagaacaaaacaagccctgaacatgcctgaaccaagaaagccaggatgtgagggtgatgagcatgagggtgtgggcatgggcggattgcatggggctgggagtgcacagcgggggagcctgaatgagcaggcagagggacctgtgggcgcttgcttttgcttccgggtcttcttcattatcatgggcccggggaatctgagagggtctcacagtgcccacagccttacccttatcccaggtgcaactgctgatcctccctgaaacaccagctcataagggcatcctcatgtggaccagaagcaatgacactggccgtgtgtcacagcttacagagcatcttcatgtgccacccaatcatctatgccctggtgggagtactatctccactcattttacagatgatgaaactgagactcagaccagtaaagctgtctgtccaaggaataaccagagggtagacttgcatccagactccaggctccaaggcccaaactctgcatctggcacctcatggtctcatgtctccggaataagtactcaatagccacagctgaggtgcctcatgcatcatgggcagccacagcccctgccccagtccccttgtctgatgaacacacatcatgatgccactctataaagaggaccgttgccagaaaggattaattcattaatgaatatgaggtctctggaaacccagaacgtgatgtaaatacccgtgctgtcaaagctgcctctctgttgcagaatgaaaagcaccaaaatccctccattgtccttggataatagctttgatttggggcagggcaggaggaaggagactctgtctgggggataaacaatgctgggatgttccaacatagcaggatttgcacacaggatccagcagagatggcgtgcttttctcaatattgtctgggatatcaaatgggaagactggaacagccaggggagatttggatgcctgagatctggagctgctggagctgaaggaattgatttccaactagatttctcacacgcctcgtgcttgggctggatggctgaaggtcagcccagctggcactgtcacctggagcacggacttagggtcttgccatggggtccaggcttctcaccgcatacagagtgagttctgaaggagaagatcttcaagggaacaagtgtcctaagagaccaccctcaaatgccatgtggttccaacttttctcaaggggaaggtacagttttagccagcccagacccaagggaagggatcagagacattcttgatgggaagagtgtcaaagatttgggggccatgttttaaagccatcacagggaaggacgtcagggtttggtataggattgagtttgaataccctagtcccagacacccaccccgtctctatgaggaagataatacagaacactccaacacttttttttcttttcatttttgagacagagtctccttctgtcacccaggttggagtgaagtggcgtgatcttggctcactgcaacctccacctcctgggttcaagtgattctcctgcctcagcctcctaagtagctggtactacagacacacatgaccatgccgggctaatttttgtatttttagaggagacaggatttcactatgtgggccaggctggtctcgaactcctgaccgcaaacgatccgcccgcctcagcctcccaaagtgctgggattgcagacttgagccaccgcacccagcccccaacactttgaattaaaccattttcatccttgaggcataagttttagggtccttaaggaacctaggtccttgcctttatttattgatgacaaaactgaagccacgagaggacacttgttatggccaatgtcacatgtctgctaagtgtcacagccagtgttcaaaaggaggctgctgactccaaatccaacactgactctttgctcccaggtctggctgctatagcagctgggctgcctcgttctttctaccaagatatggaatccatctttagagctgagtaaccagctgcaaaccagagccttccagcttctcttcctctaggagaagggcaaggaacagggcggcccagggatgtgtgctgtctagggaggctgtaggctggcagacaaataagagcagatcagctgacccccactccccccagggcgggtctatgatgggcaattggataaacacattcagaacaggatgaatgtgcagccgagcgtgagcacattttaaaatatacatttcacctccatatgcagatcccagtgacatgtgacaaatgtgctgtggcctccaggagctgttctccaaggaggcacttatttcatttgactccaagcatccaacctcaacagatggcagaattcagatgggtggcgggaagcaggcttcaattactgcaggaagactcaagttagacaatgggaagaactttccttctctggaacaccagcttttttcagcgactattttgcaatgtgatacacagactcaacatagacactttcacgtgaataaaagtgctctctgtagaaatggggggaaaaaaacctggttgatagaaacttagacttttagctcagactcccagattttctgcaatacactcattccacaaagggtgtcacccttgtgagcacttttggcttaaatgaaggctcagtgtctctttttggagagcagacaacatgttaaggacataaatatgtagatctgcgggtttacttgttttgttttttttttttgtttttttttttgagatggggtctcactatgttgaccagtctggtctcgaacttctggcctcaagcaatcctcccatcttggcctcccaaagggctgggattacaggcgtgagccaccatgcctgacctgaaatatgtagatttgaacttgaaaacctgagaactgaagccctgtaaccttttccaaactaatctgtgagacaggaaggggtttagaattatataaataagtcacctgcttgtgtgtcaggcacattttttctttttctgttgttgttgtgggggataacaccctttgtgagataaaactcacaaccatacaattatacaattcatccatttaaagtgtataatgcagtgaattatcgtatattcacatagttatgcagccatcattgtaagtcaattttagaaaatgttcattaccccaaaaagaaattccatacccttcacttccacacaaactctttgcctaggcaaccactaatcttctttccgtgtctatagacttacctattctgaacattgcaatacactagtctttcgtgtctgacttctttcccttatcatgttatttcaaggtttgtctatgttgcagcatgtatgccttcattcctttttattgtggaaaaagtgttcactgtatggatatgctatatttaatttatccgatcatcagctgatgggcatgtgggcggtttctattttggggtgatcatgaatactactgctatgagcattcatgtacaaggtttcctgtggatgtatgtcttcatttatcttggatatggacttagcagtggaattgctgagcatggaactgtacatttaacttcttgaggaactcccaaactgcttttcaaagaggctgaccatgttacactcacaacaacagtgtatgaggatccaattttttcacattctctccaacacttgttattatctgtctttttcatggtggccatcctactgggtggggaggtgcttcttttatgttatctcatttcatcttcagaacgctgccataagggcaggcactaccatcccaatgtacagatcacaatagtgaggctccaagaggttgagcctgtcaaggttgcaaagctggtaaagaggcataaagatgtgttgtcaggtttgcctgacacctctcccacttccctgtatcccagtccactctcaggcccgtcacgccacctgcatagccctctccatgtgtttatctttgtgttccacgtgtgactcattgctgagatggtcaggaatgacagcgactgaactttctatccaaactcaccttccttccctgagccttgagatggaaccatcccctcctggctgtgggcattccttctgtcaagggtgagagccagcccagactgccatgaaataaaccaacatgcttctcttccccaacccctccatcagtgcccagatccagccccactaggctccacctggctccatagctatttcacccacctcttggagcacatgaggctcttgcctggtccatcaatggcttcagggatctcccacatcagacttccaggaaatctccctttggttcaaaaaatcgtaatgaacaggaccctaaacaacctagcacctcctaagacccatgctgacatgggcccttggtcgtgagttgcatcattcagcctcctgctgaatgaggtcagcacctgctggacccacccatctcctgactcttccccttccccaccacacaggaagacaactgatgcagggagcatcagtgtcaggtgtgttgtatttatgtgacgcacacagttccctactctcccaccattgttcttcgatatatgacaaaactcccaatttgtcaaatgcttaacagcagtcaggaaaatgtattctccacacatccaccgagcttttcattttgcacaactgtcagcaagaacagtttacaaattttctgtcatggagattctgaaagaatggggaagaggggagaaacaccccccaccccaaccccttctgtgagtcacagcctcaacttgacagaagcccaggcagcagctgagactcccctgttacattacacgtcatcactctttgcatttaagcccattttccatgcagccatttctgaatgcatttctgtttccatcaaatccctccccatggtgtaaaagtaaatattagacagtgccctcctcctaaaagaccttgtatttcaagctcaaaaaagtctcctagagggactcagtagtagacagctgtctgctccacagatgccagccagcttccctggctgacatgcaacagattatcatgcaaacccagaagcctcaagcttttaagacattatatattgaaaatatacactgaatcatctttaacagaaaaaaaaaaactaaaaccaaccaaaatttccaaagagagacaatcgattaaataaattatgataacccccaaaatggaccatggtccaccatggaaagagtgtttctgtggtgtgggaatgtggttaggatatgttaactaaagcaagtttcaaaactgtatttacagtatgattcccatttagtaaatgtatgtatgtatatttatgcatagggggaaaaaagaccagatggatagacaccctaaatgttaacactcaagagattatctgctttttaaaaagatttttattttcatgtattttccacattttcttccatgaagcaaaaactttttttgaaaaagttgtttctgctcaacagtctattcatggaccattccaaaaactttaaacttggcagactgcggccagttgtacagtaaacataatttacagcccaatggctttctggcagtgagcactttttcattcacaccaggtgatgccatactgaacagcagctgtccatatgattttaatcacagtaacttttgaaaccacaacttgcagtgccccttattttgttccattaaaaagctgtcttttgaagctaatgagcaaattctctgagaactggaacctagcaaatgctgaatcactgggcgaatagcccgttaaatccatactagttatgcagctctttgaagacacacacagcttaggtaacttgaaacttccctctgagaatatataagatctctggttatcatatgtaaatgtaagtcaatgcctaacaagaaatgattatttgcaaataccttggctatgatctaagttgcagatctaatttgaggagtagcagagtgatcactttagcacagacctggaggctaagattaccctttacagggaaatcctgaatagggttgagacttcccaagagacagattctatgagctactcacaattacaactgtctaagctgaaagaaaatttcaacactaaatcccttagtctttccttttcctttctattcagtctcttctgttttatctcctttcctacccaccttgaatatttcttgagctatctctttaataatacttttagaatgtgctttcaaaacgtttgctttcagtccttcacaaccacttgaaggggaaaagaaggaaaaggacaaaaaaatatacatcccttgtgtatgagtttgctagagctgctataacaaagtaccatagactgggtggggggtgggggcttaacaataggaatttatcatcctattgttctagaaactgaaagtccaagatcaaggtgtcagcagggtggattcctttgaagggctgtgaaagaatctgttccatgcctctctcctagcttctggtggtttgctggcaatctctggtgtttcttggcttgcagaagcatcaccctgatctctgcattcaatttcacatagcattctccccaagtgcatggctctgtctaaacttcccctttttgtaaggacacctgtcacaatggatttgaacacccccaacacacacacctaatgaccttatcttaatttaactgcatgcacaatgaccgtatttccaaataaggtcatattctgagatcagagggttaggacttcaacatataattcaggtccatagtaccttgtaccaatccaaccacaactttctttgaacctatgccccaatcagggtcctgagcactgctggagaaaactgtacaatctccaagtgatagcgtgggttccagtgtcagccgagctaacactcctttgtcaccacccccttctattccccactgcagcttttttcaactttcaccatgctcctctattccctcaacttcaggaaatgatcttacctcctacttcacagaagcaaacagaggccatcccaaaagaatgttctgaccaccctgcaatgaattatttccctttacttgctgtgttagttcattttcatgctgctgataaggacatacctgagactgggcaatttacaaaagaaagaggtttaatgcacttacagttccacatggctggggaggcctcacaatcatggcagaaggcaaggaagagcaagtcacatcttacgtggataggtggtctcaggcaaagagagagcttgtatagaggaactctcggttttttttgttgttttcttttttttttttctattttttttttaattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacacgaactcatcattttttatggctgcatagtattccatggtgtatatgtgccacaatttcttaatccagtctatcattgttggacatttcggttggttccaagtctttgctattgtgaataatgctgcaataaacatatgtgtgcatgtgtctttatagcagcatgatttatagtcatttgggtatatacccagtaatgggatggctgggtcaaatggtatttctagttctacatccctgaggaatcgccacagtgacttctacaatggttgaactggattacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtgaattttggcttttgttgccattgcttttggtgttttggacatgaagtccttgcccatgcctatgtcctgaatggtaatgcctaggttttctcctagggtttttatggttttaggtctaacgtttaaatctttaatccatcttgaattgatttttgtataaggcataaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttgggttaggattgacttggcgatgcgggctcttttttggttccatatgaactttaaagtagttttttccaattctgtgaagaaaggcattggtagcttgatggggatggcattgaaactgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagaatttgctgaagttgcttaacagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatacctcccatcaatacctaatttattgagagtttttagcatgaagggttgttgaattttgtcaaaggctttttccgcatctattgagataatcatgtggtttttgtctttggctctgtttatatgctggattacatttattgatttgcgtatattgaaccagccttgcatcccagggatgaagcctacttgatcatggtggataagctttttgatgtgctgctggattcggtttgccagtattttattgaggatttttgcctcaatgttcatcaaggatattggtctaaaattctcttttttggttgtgtctctgcccggctttggtatcagaatgatgctggcctcataaaatgagttagggaggattccctctttttctgttgattggaatagcttcagaaggaatggtaccagttcctccttgtacctctggtagaattcagctgtgaatccatctggtcctggactctttttggttggtaaactattgattattgccacaatttcagatcctgttattggtctattcagagattcaacttcttcctggtttagtcttgggagggtgtatgtgttgaggagtttatccatttcttctagattttctagtttatttgcgtagaggtgtttgtagtactctctgatagtagtttgtatttctgtgggattggtggtgatatcccctttatcattttttattgcatctatttgattcttctctctttttttctttattagtcttgatagtggtctatcaattttgttgatcctttcaaaaaaccagctcctggattcattgattttttgaagggttttttgtatctctatttccttcagttctgctctgattttagttatttcttgccttctgctagcttttgaatgtgtttgctcttgcttttcttgttcttttaattgtgatgttagggtgtcaattttggatctttcctgctttctcttgtgggcatttagtgctagaaatttccctctacacactgctttgaatgcgtcccagagattctggtatgtcgtgtctttgttctcgttggtttcaaagaacatctttatttctgccttcatttcgttatgtacccaagtagtcattcaggagcaggttgttcagtttccatgtcgttgagcggctttgagtgagattcttaatcctgagttctagtttgattgcactgtggtctgagagatagtttgttataatttctgttcttttacatttgctgaggagtgctttacttccaactatgtggtcaattttggaataggtgtgttgtggtgctgaaaaaaatgtatattctgttgatttggggtggagagttctgtagatgtctattaggtccgcttggtgcagagctgagttcaattcctgggtatccttgttgactttctgtccgttgatctgtctaatgttgacaggggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttagtatttttatatgtgaatttgatcctgtcattatgatgttagctggtgattttgctcgtaagttgatgcagtttcttcctagtctcgatggtctttacattttggcatgattttgcagcggctggtaccggttgctcctttccatgtttagcgcttccttcaggagctcttttagggcaggcctggtggtgacaaaatgtctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccctgtcactttcaggtacaccaatcagacgtagatttggtcttttcacatagtcccatatttcttggaggctttgctcatttctttttattcttttttctctaaacttcccttctcgcttcatttcattcatttcatctttcattgctgatgccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctgcatccagctttgttccgttgctggtgaggaactgcgttcctttggaggaggagaggcgctctgcgttttagaatttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctggggggtgcctcccagttaggctgctcgggggtcaggggtcagggacccacttgaggaggcagtctgcctattctgagatctccagctgcgtgctgggagaaccactgctctcttcaaagctgtcagacagggacacttaagtctgtagaggttactgctgtctttttgtttgtctgtgccctgcccccagaggtggagcctacagaggcaggcaggcctcctagagctgtggtgggctccacccagttcgagcttcctggctgctttgtttacctaagcaagcctgggcaatggcgggcgcccctcccccagcctcgttgtcgccttgcagtttgatctcagactgctgtgctagcagtcagcgagattccgtgggcgtaggaccctccgagccaggtgtgggatataatctcgtggtttgctgttttttaagccggtctgaaaagcgcaatattcgggtgggagtgacccaattttccaggtgcgtcagtcacccctttctttgacttcgaaagggaactccctgaccccttgcacttcccaagtgaggcaatgcctcgccctgcttcggcttgcgcacggtgcgcgcacccactggcctgcgcccactgtctggcactccctagtgagataaacccggtacctcagatggaaatgcagaaaacacccgtcttctgcatcgctcacgctgggagctgtagaccggaggtgttcctattcggccatcttggctcctcccccgaaactttcgtttttaaaaccatcagatctcatgagacccattcactatcaggagaacagcatgggaaagacccacccccatgattcaatcatctcccaccaggtccctccctcaacaagtgggaattatgggagctgcaagatgagatttgggtggggacaaagagccaaaccatatcacctgcctcctttctttccccctctgccctgtcctaaagcaaggtgcatccttccccctgggctctagatcgcctgccctccagctcctcgggccttgcccacaccaattaccctcttgcttctgtcttcaacctccccatctccactggctcctttccattagcatttaaacatgtccaaatcttttccctcaagaacacccatagctcttatctccaggtctctccaacaacctcctgtccccaccacatagccaaattcatcaaaagagaaaaataagttatctccacttttcttgtcctcaacccattctatcagactcttgccatcacctgtggattgtaaattctcctgccatggattcctccattgccctcttaaggggccgcttggcaagcatacaatgccattgacctcatcctcctttaaatatggaattccttggcttctgagtgatcctatagcctctcagttttccttctggatttgctgtgctggccactccctagatgttcaatggttgcatttcttggcattgttttcaagctctttcccttctctttctgatctcatctagtactatgaattaaactactacctagatcctggtgactctcaaatgtctacttccagtctacttttttctcctaaattgcagatgcccacattcctctctaatattacatctcccatgggtgacctacatccaataatagttatgaaagagaacagctaatagcagtaggctgagtgatggacttaggaagggcaaagacccctttggcagggttaagaaaagcagaggtgaaatgagagaggtcaggacagtcacctgaagtatttcatagttctctaaaaagtactctcagattcaaatttccttgacactttgctaaccgttctgcacacctacatcctaaaggacagggctctccttaacatgaattaaatttgaatatgcctctaccttagaaaatatattgttcctctaccagtgtcctggcatatggagactgcctactgaaaatcatgggtatgacattgatttgtgtaatgctagctttggagtacatgtagctttttctctatggacttaaattttttttttttttgagacggagtctcactctgctgcccaggctggagtgcagtggcgccatctcggctcactgcaagctccacctcctgggttcatgccattctcctgcctcagcctcccgagtagctgggactacaggcacccgccaacatgccggctaattttttgtatttttagtagagacggggtttcaccttgttagccaggatggtctcaatctcctgacctcctgttccacccaccttgacttcccaaagtgctggcattacaggcatgagccaccgtgcccggccagacttaaattttaagggaggcatttacattaaattatacttcccacaatccactcagcttggtctttggctccattgttgggtggaattacaattgctagtacagtagctggatgttaaatagaagtcagtgtagaacaatagatgtcgaaataaaaaacaagattagaaacagaaaagttcatggcttcaaaatgcatgttagcctggggtaaaaaaactgcatggatcttacagaacatggagtccagcactgatacggacaggagatagggaaatactggtttgaagaaggcagttcccgggcaaaggccccccaccttcaagccaagaaacccacagccctcagtgagaacaggcattcctgtttttgcatccaaaaagttgccttttggcctgctatgtccccctatcttgcatccatataaaccctgaaccccaggctccagaaagaaatgcacggacgaatggcaaaatggggcagcagagaagaagagaaaagaaggaaaatcatcttcccactccattccccctctagctccccatccatcccacggagagccacctccaccactcaaaaagacccccacattcactctttaagtccatgtgcagcctcattcttcctagactccaaacaagaacccgggtgccaagagggcactgagctggttaactttagctgtctgcagattgcaaagccaaaagagcatgctgtaacatgcccgctgggcttcaggagtcgcagacacccacccttagagacaaccagggggccagaggccaaagtccttgccctggctcctaaacctgcctgtctgtgtgctccccctcccgtaaggggtttgagcttgtggcagctgaacagagaggcatacccctgtcacatgtcatgtgggggaagcagggaactctcctgtttcagcaccttcatttttaaaacaaggatactaaggtttagagagaatagttacactttctcaaggttaaactctacggaatgggatgaaatggtgatagaattcagtgcttattccatctccatgtgagaggcctgagggacatggcatcattctgctagggccttcgagttattggaatttttgcaaagcatgtcaacatcccacccggcagaaactctggcatattcacttcatccacgtgcttcttctgggaccccttgttttagccaactccatacccatacttcaggagactcctgattttcctgaactctgagtcctggacttgtgttcccacacccagccttggctcttctctcaggctaaccttagccccatttgctctgctagaatgtccctttctgttttcttcctcctttggttctactgcaaccagcctcaccaaacagtattctgctcatctgtctaggagctctgcaatacacctgagctcataccctgccacacctgccccagccccacgaaggaaaacaaaacaatagcaacaaacaaacaaacaaacaaaaaaaaaaaaccctgctgaactcagattctgattcagctagcatgaagccatgacttgtaccaggcactgtcctaggtgctggggtgaacactgtcatatttaacttaacctaccagcctttcatagaatcctgctctgtgaaatttgcacaggggccaaagggaaacaaggcattatttataataattggcttgccattatccattctgttggcgctgcctgcaacaacatgatggacctgtatgctattcacagtctataaaaaagtagttctgttgtgattcaacatatagtaatctccattttaagaggacaatagaaacactcagctgttattcatcccagagccttaaacggcagagaattcctttatcaggaacataaggttagaacagcatgagttattaacattgaaagtagcccaatgcatttattgaggtgctcaaactattgaaaaaaattaacgatttttaaaagtaaaaggctagacctcaagtagcactttgggagaagtgtgtcaaaggcacaaactattcagaactgcttaggttgaaatgaggatggggaaagagtcttggtccccataacccaactcagttctgaatgttctgaagagagtaaaggagaaacgccaggcatgttcagaaatccagatttgaggggccaggagtggtgggaaatatgggagcagctgcaaatcatagttaattaacaatcattagggatacatgcataacacattttgtattcagttagctatttatttatttattcacagccacattccacaaagggcttgaggcagcctacaatggcaaaatgcaaacaagcgtaaaaagtcaggactagcatatacggtgaggaacaccttggccagaagggcacacatctgtcagccctaagggactccagaggtaccacagtcaagttccaaatttggcttgaggcatcctggcagccaaagtgaaaaggagacagggtcaggtccaagcattctctttaacaagacactgttaaatgtctttctttcaaagcaggtaaaaagctgaacactgacacagcggccccacaaataactgcagaatcagtggtctgcaactgcagtaaaatggatgggacaagggacaatggcaaaggagttgggttctggagctgaaagtcctcactgtgaggtccagcttaacctctactagctccagggtcctggagaagatgtttaatttctctggggcacgttcttattatgcataaaccagagatttaaaaagacttaatttgctaagtcgtgtgtcagaaagaagaaaaatgaaagagggagaacgaataaaggaatgaataggtatgtactatgaagtgaattgaaacatatagagcacctagcatatgaaacataccagaaccttttctagtttttttttttctttaattctttctgtgaaattgagtctgggtagcagactgttcctccatctgagtggctgtttgtcagtctctgtcttccctctcccatcctctgcccctaccactctcttcaacctcaactccagaggtagctggggctatgccacatctcaatctcagaacaccagggcacagagaagtaaagagacccaagtgatggatgggtgggtgagtctataattctcagaggaacattattagaaacaacaagtggtgatgggcacaggatcaaccaacacaatgagagagaaaaacagtcaactcggagatcaggtaatcagtgattgataatctgataatggttgaacactcacaaggaagggccatatactgaaatgagtccatttattttacatattcctaccttgagtgcttgttcacaaatatgctttacctaatccattctgattttgatgaaaagttccattttgtagaaatggaacttttgtagaacatttctacaaaatggaacttttcatcaaaatcagaatggatgccagcaatccatccaaaaccagaatagagccagcaatactggctgtcttgatgctaaacacttttcgatatcagctaacagcatgagactaactatcgagcttttgtgttttcagtgaccgtatttttctaagccaaacatttaaaaaattcacataaaagtcaaattacttgtatatattttgaggctcatctagtttaagaaaaaaaagctatcaaaaactgaatatctcttggaaattctgagtcatacagccactgcattaagctacttggacaggtgatcttcccatttttcagatgattctccttaccttcaagcttaggtaagaagtctctgctctctgttccctttgaacttgcacacatctccattctaacacttaccactctacagctgagtttctgattagactaagaacccactggccacaggatgtctgccctattcagttgcatgtttccaaaatttgctcaataacaaccaaagggaactgttttgcaagcgtagaaaatcagttcttcagtacactactaaatgcagcaagctaccctccttttttctacattgccctctacactttttagcttctagacttctcatcctgccttgaccagccccagctaggcctctttagttgcaagattccaagaagtcagagaggacctacattcacagggcctgagccagctcggagaaacgggccccctgggagtagccacagagggtcaggtggaatccatcatggtgcatcagggctgagagttgaatctgtacaatagcccaggccatgggaggccttcctaaggcccgacttgaccactaaggatctgttacttcttgggtccccaatctagcagtgagagtgaaggaaattctcaggttccttggccaaaacctcaactctctgccttcagaatatgagcttaatgagaattccctggatgagaaccactgtcattcatttaaatcacagctacacattaccgtgaagccttatcacactgggcctctctgatctcctgtaaagggtcatcaatttctgtatcttttacttttttttgtctgaataatgaacatactgctgaaagcaatgcccgggatgaccgggcacatctaggagattctaaaagtgtgagtttcagatttttggtacgattttattttcttcatgcttaaagtctcataaaattctggatccatttaatcatactacctaatcatatgtttatcatgaaaagtagcactaatgtggtaggcagactgtttttccatgtttctttctttctttctattttattttattttttatttttttaagagatagggtctctttcacctaggctagagcttattgcagcctcgcacacctgggatcaaacaaccctcttgcctcaacctcccatgcccatgtagctgggactacaggtatatgctaccacacccagctaatttttttaatttttttgtagagatgaggtctcactgtgttacctaggttggtcttgaactcctggcatcaagcaatctttctgccttggcctcccaaagcactggggttacaggcatgagccaccatgcctggccccatgtcctgtttctaaactaataattagcaaggtaaggcaaaaacggtccttttacctgtatttgagctcacatctacggaggcttcaacagaacaattccatgtcctatttttggaagaaagctccaatttctagccctagttttcagtgttgtggagtagttttatttcctgtctttcgtattttttttttaaaaaaagcttctccaacattttagttgcaatctgagacagtctgtttcagagacaaaattttacagccagatgctccagtgtgagccgctgcagtttgtttctaaggatgatcagtaacgaatggggaatgcttgtcatttgctcaaatattgtgaagtcttgtcttttcttgggcacatgcacacttttataggcaaggtttcatccatccgtaatgcctgctgggacaactgggagaacaggtcagtcatttgcagaaacagacctaaaaccctaaggcctaggagccatcacagcccccaccccatctggacattaacaagacacacagggtggggaaagaaggcaaatgggagtgcagtggagtcaggagataggcaactctgggcctccacttccgtgggggattttaataatctccctggagtcacagtgggttgttataaggaggcagagggaaggtaggatggttctgatacagaaaatagctcctcagtgggacaggggagatgacagcagagaagctttcaaccacctttttttttgtgatgccacaagtctctgcagctcacctgtatagcgctattgctctattccacgtgacaaaacatgagtcacctgctcaattagtttcattcagtccattatccctatagctagggagagctctctcccataaactggcaaatcattgttcaatatatttaatcttaatatggttgatccttccttttctttctttttacctctcttcctctctccatccttcttattcatccatccacctatctatccatccatttacctgaaggtatgttgaccatctactttgtgtcaggtactattccaagcacttaatatacaatatctgattaaattttaacaataccctggaagttagctcttaatattctttatgaatattatatgaggtttagagagtttatgtgtcttgtccaagattcagcaaaattcagcccatgggctaaattcaacctatttttgtaaataaagtttagttggaacatatccatgcccatttgtttacgtatgacacaatttcagcagagtggagtagttacaacagagaccatttggtccacaaatgctaacatatttactaactggcccttaactgaaaaagtttgccaacccctgttcttgcccagtaatacttagcaagaaagtagcagagtcaaagattcaaacccagatctatttaactcaaaaggccataattcttcaatgctgtgtcatgcaacagaagtatgtgagttttgtctacatgacttcttgacacctagggtgagatggccaggctagatttatggtaagaggaacagatctgacatatattacttagtaagtagccaattactgtggaagactctcttcatttgtaagaaaagccagtgaggatgctttttttttttttcctggtgaagtaattatagagacgagtgttgatgcatgttttgactttgctgcaaaagtagttctgtcttctccagtttaagtaattacattagtttctaaatagagcagatggaactatagttgtcaaagaatgcaaagatcagtcaactgcatttatggtgtgacattctaagcagagataccgcaaagtatcttgtgcaaaaccaactaggtgagtgctattgagcacctgtgagccagaagaaaacaggagaaaaatgtggctaaatggaaatggaaatttctacacaatgggatctggtggcaaacacattttcctaccataatgccccaacaattgcttgttttctaatgttgcctggttgggggaagatatattctgagtgttcctccaaacttgtagaactcaatttttctgggggagagggttgtcctaagatggtctgcttggtactcagagtgcaaagatgtctcctgcaagaagcaagcagcttatgaaggaagcaatgacttaaagcagacacgttacctctaaagaacagggagaagatcaaatccagaaccaggcagtagtaataagggaactgacctggcaataggccaaggatccaaacgacatgggaaccaggcatgattcaaaacagccactgctgaacacctacaccaatggggggaaaaatgatactcttagcgttagagtccacaactgctacagagtctcagctgtgatttctactgccgggtgtccccatagaagtctgcatcccaacccctgagacctgtgaatatgttaccttacttagcaaaagggactttgcagatataattaagctaaagatcttgagatggggagattattcttcattttttgggtgggctcagtgtaatcacaagtgtccttgtaaatgaaagtgggaggtaagagggtcagagtcagagagagatgtcaagatgctacactgctacctttgaagatagaggaaggggccatgagccaagcagtgcagacagcttctaggagctagaaaaagtcagccgacagattctgtcccagaacctctagaaccaacacatccaggcaacaccttgattttagcccagtgaaacccatttcagacatctgactcccagaaggccagaagataataaatttgtgtggtttcaagccactatgtctatggtaatttgttatagcagcaatgataaactaatacaacagccctgacttggggggagggtaaaggaaagagccacacaccaccaccctctcaccatgggaggaatagttgaaatgaacacatgacttcaggtccccaacaaagagctgaatgggtttcaggctagcttgctaattcattcaccaattctcagctctggtgttgcttgattcagaaggtaaagacaatttttaaatttccttaatttcaaaacttaattcatccaatgcatttaatttaaaatcatacattatttatccacaaatcctgatacacagggaaagaaacagaaatatttgctggacaggtggcatggaaacaaagggttattagcgattgccatgcaggcctaagtgaattcacaatgaccatcatgacatcatgtctgttgttactatcaagagcgttgctcttggataagtatcaataacctcagaactatggaaagaaccatgtgtggagtttggcaccacagatattctctgagtgattgaagtctcttctaccatggtgagtggtaccatggaagtaatcttgtccccaggcctcctaagcttacttatgatgaagtgatgagactcttacccaagaaaccattacagaaaaaaaaatcctcgcctaataaaattgtgccagtgaacaaactctcagatatatggccatattgacaagatctgcaatggtatcaaaagaggtcaagctaataacctgaggaaacaggaagaaaactccaattgtcttatacagaaggtctacaatcaataggatgaagtctaacactggcgagagtggggtgagatggatgaacttctctaccacctggtgatgaaatacattgggattctatgaaaaagcatttttttctaaactcaatttccatattaattttagagctatatgtaattagttaaaaatgttcctgaagacttaaatcaagataatcttttagaagtaacaaaatgatctacacatgaaaatactcaattcagcttcacatattgccacatgttatgttccctgagaagcagactctgagagtttagcatgtagatgttttaagtggtttccgtggggtcaacagctatgcagaataggggaagttagcaggaatggggcagaaatagaagtcaagctgtgaggtaggcccaataacatcttcagctaacctgctggggagctctaaggctggaatgtgagttgtcctgttttggggatgaaatggtaaaacatttaaactcttgattctctgagtcagtgaacattggctgccccaggaaggagcccaatcttgggcaaggcaactctctaaagctgaggggattcttgaagaagcttgtgtaaatgaatgaatgaatgaatgaatgcaagcttgtgcaaggttaacccagtggacttggggtactcaaactctgcacattttaaagagaagactggccccttgaccatcctgggagataacctataagcctttggaatacctagcctgatacaaatgtctttgtgtatctggggtcttgggatatgccagatagtttatgcaaacaatgtgatttatggtgaatgcctgtttttgttcacctggggccctggtcatgctgtattggttggacgccggagactgagcagtcatggaggtaccccaggcctatgtgactagcccccagtagaaaccctagagaccaaagctcaggtgagcttccttgttggcaatccttcctatgcattgtcacacactgttgctgagaggatgaagcattgctggcacaaccccaagatcacacatgctttctcctatgctgtttttgttgttgttgttgttttgtttttttgtttttgagacggagtctcactctgtcgcccaggctgcagtgcagtggtgcgatcttggctcactgcaatctctgcctcctgcattccagcgattctcctgcctcagcctccttaatagctgggattacaggcctggctaatttttgcatttttagtagagatgggatttcaccatattggttaggctggtctcgaactcctgactttgtgatccactcacctcgacctcccaaagtgctggggttacaggcgtgagccaccacacccggccactatcctatgcttcttttaaaaccagccgttcactgttaatctgtattcttttactatattatctatatttactatgtttactaatttttactgtattactaattttatatattatactaaatttatgtaatattactaattttactatattttactatatttattaatatttactatattaatatatatcttttactatattaaactggaacatgagtatagcagctttcctgagttctgtgagtccttttataaatcatcaagcctaaggatggtctcagggacccctgacatagggctagcacttaagagcagcctgctagctgtagtctcagcagctagggtaacaaatcctttcttgaagggatagccaggtggcacatcacagtatgtacctataaaagctagaaacaagtgaaatattcataaataggacatctatttggcaaagtagaagttaggaagtacccagccaagctctgcctcatggaataagagtgctttttgagaatgattccaatatctatcttcatttgctatacatatggagaaaacagtcctctcagtttggggagaaactctgaattattcttaaagaatctctggttatcccctctagcttacactgaacattctaggtccttgagaagatcctcatttcaaaggcaatagaaaccatctgaaattgattcattggaaaatgtatatgctattaacaccagagagcagaagtagactggctaaaatatagcaacttgaaatatattttatgtactggaatttgatcaaatagatggataacttctggaatgatgacagcaaacaatctttggaaaaacacatgactgtgcttggagaacggtatcatagtttttaagaaatgtacactgcatagctagatagcatagcagtgtccatttaaaccccaatctaacacttcgttgtaagttgacagtaggagaaaatggttattagaatatggtttgacaggccaggagctatggctcacacctgtaatcccagcactttgggaggctgaggcaggaagatcacttgaggccaggagttcgagacagtgcaaaacctcattgtctttacttaaaatacaaaaattagctgagtgtggtagcacacgcctgtaatcccagctactctggtggctgaggcacgagaattgcttgtacctgggaggtggaggtcacagtgagctgtaattacaccactgccctccagcctgggcaacacagcaagactctgaaaatatatatatatatatatatatatatatatatataataaaatattaatatattataataatataatttattatatataattatctataatatattataatataattattatatataatataatatataattatatataatatattataataatataatataatatataattatatataatatattataatatattatatattatattatatatattatatatatataatatatatataatatatatattatatatattatatatatattataaatatataatatatatataatatatatataatataataatatatatattataataatataatatattatatatataattatatataatattatatatatggtttgatgggttacttgataactgccaattcagtcttgagatgaggaacaaaactgaaatatgaaacatgactggtctggtagaccacaggactgcttctggtccaccgactgtgaacgttaatgatgtgtgttcattgctgggttgaggtaagtatgagttggtgcactaccccctatttctctctttctttgtcacagaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttcttccccaacccctgcttatgtgaagcattatagtctaatagctggcattttagagagatgaaaaagatgagtttgcttcaaaatgtatatatgaccagactgtaaattcacatgcaacgcagtctgctttgggagttaaacatattatttaaacaaatcattataacttgacttattatacctcaatttgattataaaacaaacattaaagtgaaatctaaggtaagtcttttttatttccagttccaaagccatttccatttcttacttatctttgaatcctcagccccaagcacagtgcctgaaacacagcaggtatccacaatctttggatgactgaatgaaaaggaaagtttaaagtcaattacctttaatcttgcttgtggtttctcagagctaatttgaacactagatggagaaatactgaaaaaaaatatttttcagaaaggcaagcatcctcttggtctgagaggtttcataacaagttaattttattttaaatcagtatgaatggatggatgataaactttggaaagtcacacttagaactacattgaaaacaaatgaatgtgtccccagatgaaaaataataactatgtaaataaaatttgaaataaccacttgatagcaaagagaactccagtatcaagaaatattttaaattccatgcaatggttaattatattcctgaaatctatgcacaaaagggcaaaattgaagaaaaaaaagaatataggttaagatgaaattcgtgaacaagaacctgaaaaatataataggcaacaatgtgctgcatttccacatttaagaggctttaacatccatatttttctcccatgtgcaattacatgaacttataatccttgaaaaattgttattatttttgttgctaaaactgcttgtaataggagtcacagatatgtgtagtaatatgctcagatgattacatttgaacaaataccatggtaataattctcatatttggaaatgctagaatctgaattacacatacagtttgtggcatctcttttttgaagccttagattttattttattttttgttttaagaccaagtaaaaatccaactttcagctaatggaattctaggtctagttggtagaacgagatccagatggagttcaaaacacctgctgaatagtatctgtaaactgccagcttgatatcgtcaccaagaattctgcaagctgagtgtccacattggaatcttaaggacttgcatacagtgtagttatatataactcataagaactaattattaactactagactgtgaggactctttctttggcttttaaggaaagtcaccgagttaatgctgaatatatttctaaaaaattgtacttatgaaattaatagagttgaccgacaatttgaataatattaggctacagtaacctcgaacttgattactcttatacatggtaaaacaatccagaaatcctggggaagggttgtttattatggctgcatggaggttgcccaagccctggcattcttttacagtttcaagggagggcaaaagtctgaagtgggtagggactgagccatacttaataatttaaacttagtatcatggaacaattcacacccgttacatacaagttaaataaccttcatgctgtgttgcaaactgctcttcctgctatacttcaaacagatagaatcattttacaaaataaaattaccaaaatgaggatatacttcataaaactgttcaagggagaagcaaacctttggtgaagagtgtgatataatcaccaatggctttaagaatgccattgggaggatcttaaaatggagatgggccagatgcagtggctcacacctgtaatcccaacactttggaggctgaggtgggggcatcacttgagatcaggagtttgagaccagcctggccaacacggtaaaacactgtctctactaaaaatacaaaaattagctgggcatggtgacgcatgcttgtaatcttagctactcaggaggctgaggcaggagaattgcttgaattcaggaggtggaggttgcagtgagccgagatcacaccactgcactccagcctgggtgacagagtgagactccaactcaaaaataattaattaattaatcaattaattaaaataaaatggagatgaaggatggaagtgatggtgagatgtgcaagttccagcatgtgtggatctgatggcttttgaaagtatcaactgtagggattctatcatattcttacaggaacctaacagtgttgatatatatgatgaaatatagcactcaaaccttcatggaagatggtgcctctgactctggagggatacaatgaggagagagagcacacagccatagtcgaggtctccaagtctatcatgcatcagcatcaccaagagggtttcctaagatttagattgctggatgccacccccagagtttctgattccataggtttaagtgaggacctaataatttgcattttcaacaagttatcaggttattctgacactgctggtcagggaactatgctttgagaattactggtctacgtgtttcacttagaagccagaatggttcaccactgtctccttctcactgggctaaaaatccaaagtcctaaccattgccagcaaggatctatgtgatctgggccttaacaatctttctgacatcatctcctgccagtctccttgttgctagcaccactcaaggctcattgtcctccttgctgatccttacatatgccaagcttgttcccccctcacatcctttgcaattgctgcttgctccctcaacccagaatggggttcctgcagatcttcaaagggcttgctatctcacttcattcagttctttgtgcagagaagctttccataaccatcctacttaaaatcgctcttctccacagttcccctttcattactgtctgtcccttccctgaaaatttttcatatcattttcacctgaagaataatatttatttaccgattgtcagctcctctaagaacagggacttggtttgattcactgctgagttcccagtgcataagaaagtatctgacacacagtaggcattcaatacaaatttgttaaagaaaaggatgaataattgattgaataaataattttaagaaagagcaactgcaaatatattagccagcctccaaactgacaaagctaagagggtaaaggtctgagatttaaaaatcaaacttgcatctatgaaaacactctataaataagaatgtacactatatgagagaatttctgttatacataaagaagggtgaattgtatctactcacaggagccaattgtgcacatctcttcccaacccaatattcaataactttacactgatagggagaaatcagtcacagtaggaatatttacacccaggaaattggcaaacattacaattcaaggcttatttttatcagcacactactgattctatccatagataaacacattccattactcagtttgatagcctcacccatgtacctgtcacccagaccagaggtgagacaggtttgttgccaattaaaggagggaaaatgggacatctcagtataacagattgggatagactgggaagcttatctaaatcttacttcaggatgtccatttagcggggctgaacatctactttgccctgcctgagcggtcgaaacataaaacaggtggacatggggatgtgtgcttttgaagatactcacccttcgctcctgctctacatgtattatggggaaactgatcctaatcttgagtctatggatagaatatatgactcatattattcaagtctaaagttgggcccaacaatggattttcagttacacaagtccataaaatctccctctgtcttacttatgactaaatgaatcctgactatgctgtgcttttttaaaagcaggatataaaatagtacaaacccaagtttgagcacaagtaaatcaaatacatactcaagccacaagtgacagaatggaataagcaccgaaccagtaaaatttctttatttttttgttggtagttgtacaaatctattctttgtctaaacatttttgcttaaattttagtcacattgtttctgcaattaaaaaatccataatatataggttgaatttcaattttcttctctgtttataaactgttttcccacacattagaaagatgtctaagataaacccatgaattaatggagaattaaaatggcagagccaatttaaataccacatatttaaacaaacactagaaaaaaaatctcttgcaacagagattgctatagcacattaattataaggtttcagatagatttttgtaactcaaacataaattttaaagaaccttcccatttgtttctttaagttattaatgtctccaatagaaggacaagttgacctttaaatctgaaccagctcagaaaaaggcccaaatgcacacttgacctcttctacaaggagcctattttagtcacaatacaattttacccactcacaggtgctctgtagcagcctgacagtggcatttacatttttttttaaataagctaagaaataatagaacaaggaacactggtagtcacttgctttaattgtaactttgggcctctgttctgtcttatcacccattttagctgacgaatgcacttcctcattccctgttttcctcgtggtaaagtaagaaacttgaatttgaaaccagagccctgagtctcctatgccctggccatccactgcctttgcatgcagcctctgttctggccctgaatccgctctctccgcaattcccagagcattccttgggtctcaactctaaggaagcatattcctttcacgaatcattttgtaggggacacaggagggtacattcccctagcacagcctacagcatttcactaaaaagcacccagagaactttccctaaagtctcctccttagcccacagtcttctgggctttccaagctttcccactttttctcttcttgatgtccctgtctgttatattgctcctaaatttcaggacactaggagacacaaaccaatcaaaagatttcacatgctcttttaggtattataattcagtgtttacaaattatctagacattaattagatccctctcttctaccttcctggtaatcttactccattctttccaggcacctgtctttttactctggccatggtccgtcagcatttcaaattgtctacgccgcttctgctttacaaaataaccagaaaatccctctccccccaacccgaatgaagctgggaattttaacctgccatctgtcagcagctatggacctatatgatatctccttttgacagccaaacatcataaaagtgttgtctacacagatggagttcattctttacctgctacaatctggtttctgcccataccacacctctgtacctgccctcaccaagtctaacaagttcttaatcaaatgggcatgttgcaccttgtgttacttgaaccaacgtgaagtgtaaatcccacacattagaatattagagatttcataagcaccagtaaaatttatttttttattggtagttatatgaatctattctttgtctatacatttttgcttacattttagtcacattgtttggtataaagagtgtaacactagttaccattcactgggaacttcattcactgggcaccaatctttaagtatagagacttctttaaaaaaaaaaaatttttttgagacagtgtcttgctttgtcgcccaggctggatggaagtggcatgatcttggctcactgcaacctttggattcaagtgattctcgtgcctcaggttcccgagtagctgggattagaggtgtgcattaccatgcccagctaatttttttatttttagcagagataggttttcaccatgttggccaggctggtctcgaactcctgaccaccgcctcagcctcccaaagtgctaggattacctgccatgccacccagcgagaatcttctctaatcaacacaagtattgaaaataagcattgggaaaaaaatgtctagagatgtttgaaattagtggaagacttaaatctacattgaggatcaccattcagcttgcctgggctgcctctgtgtcagtcagattttgctttctagctggaaaccacccttactccatctgggaatttgaaatgtggattgttcctcgggccccaccattaatgacaacacaaacacatatttttacatgattttaatcattgtgtatgttcaatggtgtctcctggcttatttatttagcattatatcataagcatgtttaaggttgcccaatagcatctataattaccattttaattgctgcataatattccactaagtggatggtcatgatttactaagccattaccatagtgttgggaatttaggttgcttccaatttttgctaccataaattgccctgcatatagcattttcctaggtttgaattaattctttaggataatttctccagcattgattgctggtttaaagagcatgagccatttttaagacctttcatacacatttcctattccttccaaaaggactgtgctaatctgtcactagcgatgtgtgagaggccttcctaagggtaattgcatgaactgataaagtgtgcactgagaacagcctggaaccctggatgaataagcagcagtgagagctgagagtataggatatattgaagaattataggtctgcaagaattgtctttgatgggggctttatacattctctctgtctcctcgctccctcgcctgaaaatcatttacagagtcattaatgagggtctctatcataggtcaggcatcagcttttctgtaaaccaaagcctacagactttggaaaagtccctctaagtctgtgatccacacaaacactgtgagtatgctttgccatcactgggagccagattaaggctgaatgtaattctttccagtggacccagagaacttgcaaatggcttggatgagccatttatgactgatattccctggaaaagaacctaagcagttggaataagcagccacagagaccaagagtggtaaagagaggcaaggcaaaggctagagaggcatgatatgatacctccatgcccaggcaagacctggtgtcgacagagggagcaatgcttggagcctgaagtcccagtttccagtcccagctctatcttgactatgcagcctcatactgacttctaagcgtcttagagtgccctcttccaagaggacccagatacctgtctcacaggctaacatggagctgagatgggagagcatagagcttgctttgaaagatgcagggaactacaaggttattaaatccaactcagcaaccagactgtttacaccagcagtgtgcctgtccagataatattgaatatgtctgggaattcagcctggggagacaagtgagtgccaaatggtctgtttctgcaaggctgccactaagaagaggattcacacactcctggaaacccttcagagcagttcaggttattgggccaaagctagagggccttgggtgtgggctcagaattagattttctgcatattaatgatcattctttcacatcacactatatgaatgacttccaactatttccaagttattttccaactgactgagaaagctctgatccttactagttgtgggacgttgacagagttatggacctccctgagtctcagtgacttatttgttaaatggagataaaaatgcctacatttggagtaagatagggaatagtaataatcttgatggtgacaacaatgataataatgtgaataataatgtgaatctgtagagttaatacaatgtgctcactctgagctaaactaaggactgtatgtacattatcccacctaatcctcataacagcctccggaggtaggaacattaaatacctgagatcaatgaggtacccagtgagtggtaactagtattacactctttaataccaataattcccaaggaagaataacctaattagttagtgggagagcaggattgttgaaatgagtattgcctcaaggattaaccccactttgggaggttaatgtaaaaaaccaaagtgatattgattgtgttaatgaatacatttagtgctctccttggatctgtatttgacttgtaattgggtagtttcctcccactttgactctgggcttggccacatgacttgttttggccaatgggacaacagcaaactgtgggcaagtggatgcttgaaaaagtgcttgtgcatttctgcttcttctcttggatccctacttcttccacgagaagacaccccaaggccaggctagcttattgaatgtcagaccaggtggaccaaagtggagtcacccagctgaagccacctgagaccatctagttccagctgacctgctagttaatccaagatgcacattgagtattgttacgcagcattattatggcaatagctgactgatgcaaccagttccattacttcacacatactattttcttcatacatgctgataacacctggtgaataagcattttgccaaaattctacatggattgtatcatttattccttatacaaaaacccatgaggtacatgctgttattacccttactttattttatttatttattttttgagagagggtcttgttctgtcacctaggctggagtgcagtggtgcaatcacagctcactgcagcctcaacctcccaggttcaagtgattctcctgtcctcagcctcctgagtagctaggactacaggtacatgcctccacactcagctatttttttttaattgagacaaggttttgctacgttgcccatgctggtctcaagctcctgggctcaagcaatcctcccaacttggcctcctaaagcactgggatcacaggtgtgagccaccatgcccagctaccttcactttcaagatgaaaatataaggtgcaaaaatttaaataccttacccaagcttacagttagtgatgggcaagcatttcaagctgggcagctcagcttcagagcctccgccacaaccactatgcattgctttgtgcacactataagagagctcctcataccaagctgctttatacgactggttgcaaccctccccttgcctgagcataatgcctctatggacctcccttttcagccaggccaggcatcatgaatcaagagctggctgccttcctctctgagcttatggctccttctccttctttgacaaggtgctctgggaagagagaacaccatcaggaaagaaagccttctagcaaacacaagatccacagattgaaggagtgaagtgctcttcatgatgcagtgctcttaaaatccaggctgtgtgatgggcctgaagagacccgcagaaaaccaagggggccctaactgcactcttgccacttctcagtaaagtcccaagaatcccaatctgcaactgagccttcaacaggctgtgcaggtttacagccctgttctcatccaggcctcattgtctctgtcacctggacctttgtgacagcctcctcttagggcctgcagcctccagactcaccttttctaatccgccttacactccaaaccagagagacttcccaaaacacatgtcactctctgcttaaagctctgcaatgtgtccctgagatgaaatacctgaaaacatcatccaagtcccctcccaatttatcagtacagccttccaggtcttgggcactgatcttcatgtttccaaagcagagtacagggctttcctttgtctatgttcatgccccttctcttatcaatatgctcttcatcactaggttaggctcttacctgtgcatcttgtatttgggcacagatacaggggacaggggctataggatgcaatgaagaataaggtgttttgcatggagggtaatgaccctgggtcttcctcatctctggtcatgagccctcaaagtccagagactcagcaaagtggtcttcagtgtaaccccagagcctggccccaggagcactcagggactttctgggaggtaggctgtgagtaaggagctccagattcatacacattaaggtaaagacctgggataatgatcagcaattcatttacattgccttaatcacaacacttagtccttaagcaataacttatattcatatgtattgcacagattactaagtatgtgctcttccatttctcattgaaggtacagtaaaagccttgccatcactcccattatacagaggaagaaactgagacctagagaagttcagaaccttgctacatcaatcagaagtacaagccaaggctcatgaagtggtttccttattttctcaccccaagttagtaagtctgtaacttctccttcacagtgcaatttgtcacgcagtctatggcactgtagaatttggctatagatccctaagtcagaaaagtccatgtttggagaactactagtaagtcaagacagaggagtgtgacaaaggctgacaaaaccctacctgcagcctggaggtcacaggcagcctgctttttgagtctccctgaatggaggggaaggggctctccctgagggaatgtgctcaactctgggtcgtgtggaagagttaggaagttaacactccatgagcgaccctcatccaatgtcggctgggaatgggtggataaataccctaactttctaaggtatatgtgtgtccagcagggcctccagtggggatgaaccacagttggccacaatggtaacctgcccattaacacacccttcattggtctttattcccttccctgagccttcactgtgttttcagggatcacctccgaaggaaatgacttacacccaaatcaggatctgtttttgagggaacccaacataacacatggagagatgggtttcctatgaagaaggaaatatgggctgtaaaataccacggagagtcagagtaagtacaggcggctacaacaaagatagatcaggtcacggaggtctctgggaatagaggaaagccacccagaggaaaaaaggacatgactgccactagcaccatatgtatgtttcagatgggatgtgtatttatgtgtgtgtgtgtgtgtgtgtgtgtgtgtgtgtgtgtgtagggaggggtgacagagagagagaggcagaataaatatcttggtcattggttacaagccaacaaaactgaagtgatgaaactcagtgagttttatagaaatgtgctggagatgcttcaattactttctcaataggtctattttgataactgaatgaaaagaatccatgtgaagcacctaccactcttcctggcttgtagtgaacacacaaaaagaattgttgattattgtagtagacactgtagtgtacctcctagattctccttacccagccactatacccatccccattgctgtgaggtcaggtgcccaggaatcacagcatcccacccacccttcccttgctccaggcaatgccctcaactggtaggtgtcactttgcccagaaactaccattcttctccaggggacccacggccaagggcaaactggcataggctatgcaaggctggcccctggcagaatgtatgtggaaggggcaactcttcagtgtgctttatggaccatggaccaaatccagctctccatttgcttttgtaaattgttattggaacacagccaccccattcctttttgaattgtccatggctgctttcctgctacaacagaagttgagttattgcaacagaggtcgtctgggccacaagatctaaagtatttactctggcccttgatggaagaaacttgtccaccgagccctagagctgcacttccaatatggtagccattggccatatgtggatatttcaatttaaattcattaaaattaaataaaattaatatttcagttcttcaactccaaaaattacattttgagtactcagtagccatgagtcgctggtgactctcctatcagcccagatacagaacactgccatcttcacaggaagttctgttggatggtgctgcactataggcttcagcttctgggtaaaactaaggggatacttaacctgaccacattctgactcaaccccacccacatccctccctcctcaacaggttcctccctcaataaatcacatgtacctgttctcctatctcaggctctatatctagagatcccaacctaagacagcctttttttttttttttttttttttttttttttgagatggagtttgctctgtcgctcaggctgcagtgcagtggcgtgaacgtggttcactgcagccttaatctactgggctcgagcaatccttccacttcagcctcctgagtagctgggactacagggtgtgttaccatggccagctactttttaaaaattgttttgtagagatggggtctcactatgttgtcagggctggtctccaactcctgggctcaagtgacccctcccaccctggcctccaatgtgttgggattacaggtgtgaaccaccatgcccagcctccaatgactaagatagttatgatatgcttgtattgcatccccaggttcatatctttgccattcttgtgatgagagtgtgggctactaagacacaggggaggatgccaggttcacctctaaatctccagtctccactacagtgtctgtcacagagcagcattcagtaaataatacatgaataaataaagtaaataaatggtcccctcatatgctgtacccctggtgtcccgtcaacagcccagagctcctcttaatccattcccactgcacgtttcaggttcaatttctcagacattcactttacccggaagtccagctgtgacagctaatagatgaaaccatccaatttgcaagttcccctgagtctctgctgtaaaatcagcctgatcctcaggaagttccacacctaggtctccactctcagccctatgacctcacctccacagactctgcacttgagcattccaccctcagcgcttgtgaaaggagtcatgggagacacaaggctggaggatgtgtctgcatcttcagaaacccgctaacagggacagcgtctgtgataccggctgacgctcattaaaccaaggctctagtagcctgttcctctcagatttcagaactaaaagaacagtctggttatcctgacttcttcttttatcataagatgctgcaagtcgaatctacagcagtcagggttaagagaaatcattaagtaataacaaagtcaggagtttcttctctgaggtaagctttgctggaaatttctcgtccctactcaagatggcaaccaaggacactttggagatagcagcttagaaatggccctgaagtgggtctttccttagactttaggtgaaaacactttcccctgatcctctggggaaacggctcccctgaggttgtctggggtttttacagagctcttctaaagaccctgggccttggggcatgctgtttaatttactgggttattggctgtcatattgaagacaaatgcatccaaggaaaaaatggctcaagaagaacagactcctccatcacttcaatcaaggggtccttcacgaacatgcttcattaacagcaaaaagggctgttggggtgctttgtccttactctacatccccctctcagctctgcaagactactgctgtcctcccagcaaaccaagcccggcagagagagaagccatcacaggaacacagttggcctcagcagcctgatgctctcaaggaatgtgttgaatcactacacagataatcagaaggcagctgctaaggttcagaagagaaacagcaggttctatcattaagtgagaagctgcccacatgaagagttgccctaggcccccgaatgtgactaaaacacagcccaagaaggccgctacagctgcaattccatgcctgtgctgaggcccctgcgtgtctagcgccactgtactcttcgactccaaggtgtaccattcatgtggaaggctatgtaaatcatgcttcttggagggaggccaggccacagccctgcaggtgggcacatcctgtatcagtccattctcatgttactgataaagacatacctaagagtgggtaatttctaaaggaaaggggatttttttttttggtgtcgttgttttttttttttttttttgacagagtctggctctgtcgcccaggctggagtgcagtggtgtaatctcagctcactgcaagctctgcctcccgggttcatgccattctcctgcctcagcctcccgagtagctgggactacaggcacctgccaccatgcctggctaattttttctattttttagtagagatggggtttcaccgtgttagccaggatggtctcaatctcatgaccttgtgatccgcccacctcggcctcccaaagtgctaggattacaggcctgagccactgtgcccggccaaggaaagaggtttaatggactcacagttccacgtggctggggaggcctcacaattatgtcagaaggcaaggaggagcaagttacatcttacatggatggcgacaggcaaagagggagagcttgtgcaaaggaactcctttttataaaaccatcagatctcgtgaggcttattcactatcatgagaacagcaaaggaaagacctgcccccacgattcaattacctctcactggatccctcccatgacacgtgggaattgtgggagctacaattcaagatgagatttgggtggggacacagccaaaccatatcacatgccttgatggccatgcagaacactcatctctctctttgctcacctataactggggcagtctgatttcagaatcatacactccatgttctcaccacatcctataagccaagttcatggaggcacacatttatgtggtgaaagtccatctctataaacgtatccatagattcctcacagagaaaaagatatgaatgctggttaaagtaataactccctcatctctggggagtatgggaaggtcctgaaagagcccctaagttatgcttgatttactgcaaaaagtgtttgctggttgagagcagacatatccctccctcaacttctctctcatgtttggagagacaacccaggtgcagttaacaagagaacctctttgcatttgcatagcactcaagcatctgcagcacagagccaatcagagccttgccttagctcctggatgcaggcaaggcttacttgcctcaggtctatgttatccaggcaaggggaagacaaggagggcagtaagagcctgctccaactgtggtccccttataaagagctctccaaaaggccccaccctccaccactctgctttacatctcactggctaacacttggtcacatgaccacactcagctgcaagaggggcatagtcttttagcactcacatcattgccagaaaaaaataatcccatctcaggaagtaagaaggtacaaacagatattggttagcagtctcttccacttggctccttttttacaggtgatgaagcacagaatgattaagaaacttgtccaagtaaacagcagaaccaggacttgaaatccaggttttcccaaccaacctccaataccctgtccactacttccttaactgaccttctgcaccactgaggtttctgcacaaatcactgccagatgctattaacaaggcagtatcctccctccctcaagcaatctcacacacatacatatgccctcctccatctccctgggctcatcaggatcacctcattttctaaaataaatctgtcacctccatcaatcatgaaaaacaattgctcaatcagctgcagtagagggggccttttcaaatcagggattggactaaactggaattgaccagcagattcatttcaatcatcaccttgacagttacaggcagacacagtcacagaggccagggttgttgaaagactcagcatgcacaagaaaagtgcttttattctctgctgcttgcatttctgtcttggctctgcagggacaataaagcagaggtcatctcctaagctgctctgagatgcccaagaatacttatgcaaagataaagtagaagagaaaaagcaatttccttcctatatttttaagttctcaggaaaacaaccacagtggagaaaatactcatctctgccagtgtgtcaaagaatgacaacggccaggcaaatgcaattggatcttatgtgttcacagtgagaaaagaacacaattaagaaaccccagcaatacctgaattcttgaggaagtgcatagacctccatttctctggcgaagctctccagagaggcccccaaaataaactaaaggctactttattcactcacttttcaaatgggtgagtgaataaagtagcctttagtttattttacacgtgtaattaaatggctcttatatctgaatggtgtcagattataaagggttctataaacaaaaagcattttgataaaggaaagtgaatttggtatatattattgtgagagaaaaagataaatgcctttacagatggaaagtctaaaaatgatggtattgaatgtgacaacggacatatattaaactagaataaataggaattaacaaacatggccaaacccctattgcttgtcaaagtcagatataagaaaatataggcataccctattgatctcaaatgtcagaatcaatggacatttgtttaacttctacttaccaacaactgtcatggatattttctcaaatgttttccatttagtgactgtttcaaatctatgagctagtcatattttgttcccattttacagatgagaaagctgaggctcaaagagattaagcaacagtcattaagggacagaggcaggggcaggtctggaatccacttgctgtgattacaagcccagtgaggtttctgtgccttgagcagttgccttttctagaacattactaatgatattcaaggcaggttgtattgctgagcagagacactggaagcttcatctaggttcaaagtttgggtgtgccactcattagctctgtgaccatggacaagtgacttccttctccaagcttcaccctcatccttaaaaaagggataatatggccaggcacagtggctcatgcctataatcccagcactttgggaggctgaggtgggtggatcatctgaggtcaggagttcaagatcagcctggccaaaatggtaaaaccccatctttactaaaactaaaaaaaattagctgggcttggtggtgtgtgcctgcaatcccagctactcaggaggctgaggcatgagaattgcttgaacccgggaggtggaggttgcagtgagccgagatggtgccactgcactccagcctgggcaacagagcgagactccacctcaaaaaaacaaaaacaaaaacaaacaaaaaaaacaaaaaaaaaaaggaagatggatgatactatatcttcaattgctattaataagtagagaatgtaggtaaaatgcctgccacatattgtttctattctattcaaatgacaaaaaaaatggtctattaaacattcattatgaaatcaggatacttggagagattcctttaaggggaattatctgctctgaatccacattgccatttgcatgcttagaccacgtagcccttcattcatttaacagaacctccttgagtacttacttgctcaatgctggaccatgctgggcactgaggtaccagagcttagaagacactgtgatcactaccctgaggaatgtgctgagggatggtgcacgaagcagggtgttgtaactttccagcctgcatctggttatgattgctgtggctctctggattctttctgccactggttgctgatttcctgtttccctctcagagcatccccctccccttcactcatgagtcccagagctcctagaaactccaatctgtgctgtcagaaccaatcctactcatcacattcctttctttgctgctgggaggctactgaagacattgatgcctatggtgcctctgatagcaggccaaatcaagggcctgatggttgccaagggtgagtccctgcctttgtgtcacctcccccatctttgtgtcacatcacttagtgcagatttcctgaacagtgtgtccttcagttcatatgaggtgcatgtggtagaataatcagaatggatctggcaacactcagacctaaccctaaggacctcataaaaggcaaatttcccagcattctctttctccatcataactttccaggactgaccagtgctctaccagttaatagcactgacagcctacatcatgtgtgaagtcctgtgctctgtactgggaacccagcagataaataagactaacagactgatatgatttggctatgtccccaaccaaatctcatcttgaactgtagttcccatagtactcacatgtcgtgggagggacccagtgggaggttattgaaccatagaggcggttacccccatgctgctgttctcatggtagtgagttctcatgaaatctgatggttttataaggggcttttcccccacttgccctacacttctccttgctgccaccatgtgaagaaggacatgtttgcttccccttccatgcttgtaagtttcctgaggcctcctaagtcctgcaaaactgtgagtcaattcaacctcttttctttataaattacctagtcttgggtatgtctttattagcagcatgagaacagactaatacacacaccttcagtcttgtatggcttacagcctatcaaggacagcatcaagtatcacagaattgagtgataataaaaagaaaaaggtagatgatcttgcaatcatcaggtgcaaattcatggcagcaggcagctaaggagtggaaggctggaggtcaaggagaagcccacagatgtgtctgatcttcacaggccagtctagttgtggaattctccctgacagcgtattaagatacacctgcattctacctttgagagtaactggaatatttttgtcataaaattattttgaactatttaaaaaatagtttcattttcaacatcacttggtttccaagaacttaataatttatcactgtctgtggtttctctaatcactttgttcctttgggaattcttgatctgcgaggaaaactaacccacagtttatcgttaagtgtaatgaaattttttgaacagtaaatttgacaatatctataaaggcatgtagacacatatgtcatagataacgaattcttgttagcttcaattattcagtattctttttacatttttgagtcaacatattgcttttccaggccgtaaaacatttccataagtcctgaaatctcctgaccacaaagtaaaataaggaaaaagggcgcagaaagggagcaggacaggacaggggaggctggagaagctcttgcagggcttcaaatggcaggaaaggtagtgacaacactcccaggatgttagaggccatggaaactatgtaaactgagggagaaatcaggctaggtttggtgttgggatgctccccattgctgtcccatagagaatgaacagcagcaaggacatgaagttggtaattagcacccaggaggagaaggctggtagaaaggtccaagaatgatgcaagaaggctctccctagcacagtgcattcaaggatgaagaaaacaaaaaacaaaaaacaaaaaacactgtcccagacaggcaggcaggcaggcaacttagggaggacctctcaaaaagctgcagtggaacaaggaagtagcaactggccacaaatgagaacatcccacaccagacatccagggccactctacccccagaacccactcattgagggcacgaaactattcaagcggatggttactacagagaggggtagggacaagcgaaagagttatctctttgcagactgcactacgtccaacacatccagacaataccagctttgctggataactatttttcctgtgtacctatcatgttctgggcaccttgaatgactctctacatatctgttcattaaagcctcacaggagcccactgagatgggtacagttattccaaatgtatagataaggaattagcccagagaagtttagtaagttgctcaggttcacacagctggtaagtagtgagatgagagtttaaatctggaaggtcatactctccttggaatatcctgtggcttcccaaagcccactaacatcagggcaagaatatcactactacccgcattgaagagaaatttatagattatatcttattgcattaatgttatatgcatttaaattcactttcccatttagtcatcacgagaccttcttcagcaatgacaattcaatggatccaatcatatcatggtgtatttgatcctatcagcaatgagacatgtaataccccttccaccctgaaaaggtccatttcaatggaccaaaaatggaaaggtatggaagtagcaaaattaaatcacatttaaaaatacatcatcatctactggaaaagaaaaaatagtaataatctgccttagaaatttgccagatctcagctgggtgcagtggctcacgcctgtaatcccagcacattgggaggccaaggcaggtggatcacttgagttcaggagttggagaccagcctggccaaacatggtgaaaccttgtctctattaaaaatacaaaaactggccgggcatggtagtgcacccctgtaatctcagctacttgggaggctgaggcaggagaatcacttgaaactgggaggcagagattgcagtgagccgagattgcaccactgcactccagcctgggtgacagagcaagactccatctttttaagaaaaaaagaaatttaccagatctcatatttataccttggttatgggtgtaaaataaaacatgagacttcaatgaatagtggcagcaaagactcctcaggccacatctgtgaatgggagagtaaaactggagaaaaaagaaacagatctaaaggataaggagggaacatgcacagtagtatggctgattgggtgtaaaggctaaggatggtgaggggtggattccaaatgactctcaggtttctgatctgggcaaacagtatgatgtttaccaaattggagtagctatttaccaaataggagtagaccattttcagcatcaacctataatgttgaggtaggtagaaaacaggtaggaaaagtagtcaggcataaggacttgaagttcagaagtggggatatattcatgtcttgttgaagtcatggaacaggtaagacatctaggaagagtttgtgtaatgaagagagaattgggcagaggacacagccctaagaaataccatcaagtgcagaaatcagagatgagaaacagtggacatatgatccttgaagcaagttctcaatgcacatgagctggatagagcttttattttaaaaataaagctgacatgcagctcacagggaggtaaaggtggaaaatctccctattgaccctggtagatgggattgttcttaggtatggaggcatggccttttcttccttaagagggagaaaagctgaggcaagataggaaagccctaaggaaaatagagggatggatgtgggagagaaaatgtcaggtgctaaaaattcagagcctgcctaagccaagcctaaaggaaagataagagcctgcaaatatttgacatgtgttaacgccagtaagggagagaatggattccgctccaaatagggggttgagacttacaagtagtgataagaaataaaagccattgattatcagctccaaacaccaaaccacttgtttgcagagttattgtctcaggaaaacagagaagaataaaggcagaatgtcaactcataatagctatagatgggcatgtccaaataaacaaagctgctcatccactgttgaaggcagggtgaaaactgacccaatttttgaagaactgtctcaaagtcttgaaaatgctcactgacccagcaaggacggttccaggaatttattccaggaaaaaatattacatatgtgcacatatattagtatctttcaggatgctgattacagcttttaaaaattaggaaaaacttacatgtctggaaatcaaagttaggatgaaatcaattgtacatctatataacagtatattaagactgtaatcaaaacaatgcctccactctctcacccccttttcacctatcatatgacactggcttttgcctgcttatatttttaatatctgttaatgccaagtcacccatcactccaacactgacaaatccaagtgatatggtttggctgtgtccccacccaaatatcatcttgaattgtagttcccataatccccatgtgtcgagggtgggaccaggtggaggtaattgaatcatgggagtggttgcccccatcctgttcttgtgatggtgagtgatttctcatgagatctgatggttttataagggttttccccctttgctccacacttctacttcctgccaccatgtgaaaaaggatgtatttacttcctgtcccaccattattgtaggtttcctgaggcctcctaagccctgtggaacagggagtcaattaaacctctttcctttacaaattgcccactgtctggtagttctttatagtagtgtgaggacggactaatacaccaaggggaccctttggagcacctcttactcaatccttcagagttggctactttctccatcctcagttttgctgttgacctgagggcatcacaacttccttgttttcctcctgcttttagttgttcgttcatggtcttcttttcaggctctttcttcacaacccaaccttatggtggtggcattccctgggattggcctctcttgtctctccacatgctttatctaggttgatggcatttattagtatggctttgtgggggggaaaaatctgtgcttcaatgaaaaactgcattgtttatagctcatgcttccttgttatcagattctgattctatgggagctgtttcccaactctggaaattgtagataactgataataatgcagaataattcttgtccatagatatgcaaatggttccatgatcaggaagagggacaaccttgctccctcaaggaaaaaaagctagttttgcttccatttgcatattcctgaagtatacagatctcttacctttgaattttcctctgtactggctgtaacacctcaccagtttcttcattaatgaattaaatgcaatcatgttcatttttacatctctgtgaggtttacctttttttttttttttaccttttcttaagaaaagtaccttgattttaccttttcttgaaaattatcttttaacagttttaagttatatctagagccaaagaacccaaatgtatgtctctatcactgacttgtacatatatctaactgattcttcttattggaagtaatgttctctaaagttgcactgaattactgaatattgaacccatggctcctaggagaaatacaaagttcagttcctgtgagcctctgctcacaatgcttttgtcaaatgattaatatagaaccttgtttatgtacataaccttgttctgtgtgtttctgtttaaagacagcttacttaacagattttgtcaattcattaacattgaactgacagccagcagccctgtaactcaggcctgaacaaagctcatttaatatacctattttctctgcaaagcacatcacagccttcttgcgcttaggaacatcagatgacacttcagcactacacttgggggccacttaaagcagcaaaatcaccaacagcacaaaaatgtgaaaaacataacactaaataaaccatgaaaagcacactcgtttacagtaggggagctgaaacaagaaggcagagtgctacctctgaccccagctagtaatatgtgcactgggcaaccaaaagttttcactgttccgtgcaggtctgtgaatgactgggagagaaccaagagtactgatgttggtgttacaaataaattttagtgagtagataaacttgcaaatatgaaatctgcaaataatgaaaactgtatttctgtatctatattaaatgtaatgtatgtctcccccattagtattcaggatccataaaaactaagaccatatctattcaattctattatatattattcaatttaatatttgcatttattgaagtaaaaaggtacttgagtacatagaaaaatattcattatacattgttttaaagtgtgttactcaacaacatttacatattagctcagttttgtccagggagatatatctgtctgtattaagaaaagtaaaccctaatggaaagaaatgtctcaaaattttgtataatctccatgtggtggggttcatggtttctttttacatccttttttagtgtttttctgtatcttccaaaataaaataatgaaaacatatttttttcatcattgctacgaaatgccattaagacgtgaatacctgccttaacttttccactatatacagcagaagtttgaacagctccaggcaccaggaactctctaactctcaaaaaaaacatctgggtcagcacctccagcctgctcatatgacagctttaatagctcatccccatagggcctggtgctctcctaggtaatatctttcatctatctttggaatatgtggccagaattaaatgtcatggtcttgggatattttgtgtgacatattacaggcatcccactgcacactcagtctgaaccctaaactcccataatacagaataccgttaccttgatagccacacctaattaagaatgtacactcatccactcttcaaactaccagatgcgccagccagacacagaggtctgtcctcagggagttagagtctaatctattcaagacagtgggatggtctttcccagcctgtgggaggtctttagatgtctaagctgccatggctttggtcaaatgctttggggtgggtgcggggaaagtcaaatccatgtaccaactataaaaggtaattaagggttatgttattgacttcttccttctaagggatattcctctgggctcaattttattgtgtttagttcatatacagtcctatataaaatagtgtgggtcaagtttaaatggattcgctgcttaaccttcaaataaaaaaaattcaattaatcagagctcttgcctcctccatcccatcgccaccacctttcccccatgctgtctggttaatccaagattcacagcacatagaaaccttctgtagtgaacagacggcaggagtcaggtgagtctggggtcaggagatgctatttcacagctattacgagatttgagatttggggaaaattactttactcctcagagcctcagtgtccctgtgtaaaatgacagtgatcatctgaattaagtcgcagggaaactgtgaggaccaatagaaattgtgcttataaagggctctaggaagattgtactgtaaaggctatgcaagagcaggtggtgctggccacgtggaaggggctggagctttcctcccaaaataaatttccctaacagggtgtctgctccaccattatgtctacaagttcagaagatttgtaaatatggcacccactctgataggttctcttacagctgtgaagcttctttgggtcaggctctaagcttccatcccttctccctcccaagaaactcccatactctccctccccagtccatcactgtttggggtattgtaagcttattccagcaacggtgctggaataataggttaaatactgaaaaacaaagttgaaacttccctttataccaaagaccaaaacaaaccctctattagttaatgagctaaatataagacatgaaaccattaaaaaagccaacttggtaacagttgttatcactgagtgatgctttgttggattcttttcattgttgtgtgtatatttttatgattttccaacttttctccagtgcacacatttgtctccacaacattcattcatgcatgcaacacctatttattgcatccctccaggtgccatccatgattccaggcactggtgaccagaacagacaaggtaacgatccctggggagtatatagtctaatggaaagggcaagtaataaacaaatacacacacagataagtagacaactatgaattagggtaagtttggtaaacagtgttttttgtttgtttgtttgtttttattttttcttgagacagagtctcactttgtcgtccaggctggagggcagtggcatgatgtcggctcactgcaacctctgcctcctgggtttaagtgattctcctgcctcagcctcccaagtagctgggactacagacgcatgccaccacgcccgtctaatttttgcattttagtagagatcgggtttcaccatattggccagcctggtctagaactcctgaccttgtgatccacctgccccagactcccaaagtgctggtattacaggtgtgagccaccgcacccagccgtaaacagtgttttaaatggttaaaatggagagtgaggaggaggaagctagaccaacaaggtcctttgcgaagtgacttttaaagggacatgtaaagggcaatgatgagttaactagttcacacaaaacttttctgtaaaatatttattttatgctgtagagtgaccaatgagactaaagggcatatggagcatgattacatgagaatgaggtcagtgactaaaagggaatagacacaagcaaaaaatatatatttaattggaatatgaaatacatttcctattttcaaaaggttactttcaaatttcaaaaatgtgctacctctttttttcaagtataaagatgaagaagataaagaagtaaaatggcagccaccaccagagtagttatagtggctgcatccattttccgccctaagcccaggtgggaaaagggttggctggaaaagttacaagcttctaatgattaagaagccccatcaaggaaaatctacatggccgtggtggatggacaaccactctctggtggattcccattgaccttcgagaccccctaactcccactctcacctcctgctacacctcatctcaagaatctcaggatgacttgtggctcaagccaatagtgggtgggatttagaaacaactgacactctggttttcctcttttctgtcaggcagagtctttttctctgcaccaagccaggtttgggctcactgctcaggataactctcccattcttctcactgcagggagacctctgcgttccagaatggccagcaatggacagggtgcccttggcttcctctggctcaggcatcattttggctgaggctgcataccaagctcttgatagagtgagctttgtgaacacagcaaagggctagcccctcagactcatggcaatgaggatttttggggtttaatggtgaggaaggcctagggcctaggtaatgagagagaaactgaaaaaagatagcatactgtcctcttaatatgttgtaccagttaactcacctgcagaaatgcctgttaagagcctacttcgttccttgccaaaactggttactaccagtttgaaacatataagtaggtaatatattgataatgagagagaaagtgagcccctaggtgttaaagtaccaaaggctccaatttactaagcacctactaagttctaagcattgtacttagagttctatggtcagctgggtccagagcaggactctaatcggactcagtaggccccaacctcagctacttcctaaactgtgtgacttggagcaaaacactaaatctctctggccttggtagtaatggtcatgataaaacctacctcatggggttataggtttgcaggcaaagtcagtggggtaagccttgcagagcattattagccatcattaatattaatgacctgtatttctatccagtgaggtaagcagcattatactaattaacagagggggaaactgattcacagaggtcaagcaattgcccaaggctgtccagcatcctaaggagtgaatctagcattaaaactctgatgggactgaaagcaaaccccctatttaactgtcccttactctatttgaacactgagcttgaagcttggtttgcatctcagggcttagcaaatttgggactgtttctgtactgtccaaaaatgtcaatgattcactaactaataaaaataccctcatatagagtgttttacaatttataacaatcattcacattcacatttgactccaatgggtacaacaatttctaaattatataaatttttgtgacccacagtctcaatacctgaatatatgtgtgtgtgtgtgtgtgtgtatgtgtgtgtgtatttatatatatacatgaatatatatacataatatacagacatatatatggcatgtctgtctctgtacctatacccaagggcagataggttaaaatacatattttaagaagggttgtttccattcaaagaaacactttgatctcagaatgagccgccctcccccaaccccacttaatgttcagttcagtgcaaaagatgtacaaagaggggcctggaaatagagtctagagaaagttgaactgctctaggaacttgaatgagaagactttgctgcacctgtgggcaatttgggagggaggaaacagaaagaggtgaaaatttcttgcctgttgaaaggacttttaaagtctgagaaaggatgagttctatgctgggcaggacggcaatgcgaccccttgcctgagtcccaccaaacaccaagagaagtttgctgctgcaggaaacagcctttgttatgtggcttcggcagggtggtgtggaagggcccaggtccacatttggttcagttaggggagccagaagaatttgactgatgttctagaatccagggcaggcagtgaacaggggctcatgtgctctttttgaaatctccatgtgcagaatttgaaatggggagttctggtcaatacttcatagatttcactggtaaactggccccagctgatatgcggtctgtgtatttatatttcacaaaactgacacagtaattacttacactcgtggttttgtaggctcttttttttaaaacttcctacagcatgaacattaacccatgccattagatacatataccacaaaaacagtttgtaacaatactagcatagaattccactgtgtgtgtgcaccaaaatttacttaactactctccaatcgttggtgcatttaagtgatttccaagtctttgtccttataaataatgcagtgatgatctctgtctgaaactctcttttgagcagctctgattattttgctagaaaaaaaattagcaaattgtcctcttaacatgctgtaccagttaacttacctgcagaaatgcctgtaagaacctgctttgttattccttaccaatactgcttattaacaatttaaaaaatatataggtaggtaatatgatagataaaatgcatttatttgatcatctgtaacactggacatttttaatacgctttttgctattcatattttgtttagcaattacctctttatgcctttagcctttttttctatcaatgtgattacattttaaagttagagctttttatgtgtaaagatattttatctcccttttctcagttttgtcacatgttttcccacaccagtttactaacctgctttttgattttagttaacatggcatagaagatttttctttttcttgtctttctatgtagtaaaatgtgtaaaccatgacctcaatggtgtatttgcttgcttttaatgaactgagagtctctcccaataaaagaatgatattttctttatttttttctagttttgccttttaagtttttaaactacccataatttaattagcacatggtaatatatgcaataaattctattttttacaaagtatcttaccatgtacaatttattaatcatgtactatttgataagcaattttcaattcatataaattttttatttttgtaaagctggggtcctgctatgttgcccaggctggtcttgaactcctgggctcaagtgatccttctgccctggcctcccaaagtgtcatataaattttaaaagtcaccagtggaacagaacagagccctcagaaataatgccacatatctacaactatctgatctttgacaaacctgacaaaaacaagaaatggggaaatgactccctatttaataaatggttttgggaaaaccgggtagccatatgtagaaagctgaaactggatcccctccttacacgccttacacaaaaattaattcaagatggattaaagacttaaatgttagatctaaaaccacaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaagtgggcaaaggatatgaacagacacttctcaaaagaagacatttatgcagccaaaagatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaactggaaataccatttgacccagccatccaattactgggtatatacccaaaggattataaaacatgctgctataaagacacatgcacatgtatgtttattgcggcactaatcacaatagcacagacttggaaccaacccaaatgtccaacagtgatagactggattaagaaaatgtggcacatatacaccatggaatactatgcagccataaaaaatgatgagttcctgtcctttgtagggacatggatgaagctgaaaatcatcattctcagcaaactctcgcaaggacaaaaaaccaaacaccacatgttctcactcataggtgggaattgaacaatgagaacacatggacacaggagggggaacatcacacaccagggcctgttgtggggtggggggagggggagggatagcattaggagatatacctaatgttaaatgacgagttaatgggtgcagcacaccaacatggcacatgtatacatatgtaacaaacctgcacgttgtgcacatgtaccgtaaaacttaaagtataataaaaaaataaaaataaaaaataaaggctgaaagaaagaagaaaataaaataaaattagttatgtaacatctcatcataagttgtttataagaccaatcacacaggacctgttatgaaaattccatacttgtaaagtgctacccagagcctgacacgtggttggcactctatatgtatgagtttcttttaaatttatttgggatatttgaatgcctatttatttttgtgaaagggtttatgtttcaaaaattaaaaaaatatactttcattcatgcatcaaaaaaaaattttaaagtcagttttgctatgtactgtattcatttctgggctttaattattatagtttttacaaatgttgacatttcacagagaaaccctccaatcactttttctaagtgctcttgacttctttctcctgtattttctttcagatcaacttttaaatcactttaagtttcaaaatgaatcccattaagattttgattagaactgtattaaacccatcaattaatttgggaaggattgctatcctcacaatattaaatttgctaatccaacaacatgacatatggccatttgttcaggtcttgttttctcatcctcaataaaactttgtaggtgtttgtattttcatatacatgctgcacaattcttagcttacacttaagtgtttatactgtaattacatttaagaataggatacattttattatagttttataatggttattactggcatatggctatttatttttgtttatttgctttgtgtctgaccatagcattgaaatcttttagtagttccaatagcttgttttttcagttaagtttattctcttaggcattgaggctataagaacgttttcttctggaaataagaaggtgcctttccatttctagcttactaagaattctgatcagtaatgaaggctgaatcttttcaaattactttttagcctctcttgagaggctcagatgatttttattttttggcctactaatatgaggcattacatccatagtttttctaatattcaacatttttcatcagtgtattcctggaaaacacccaactgggccatggtgcattatgcattgataatgattctggatttcaggagctagagctttgcagctgtgcagttaagggttccattttcatccgggccatttgagcaagtgtgtggccttgggcaagtcacctacctcctagacagtgagtggaggaattatacctccctcacaagcttgctgcaagaattacaagtaaaatattcaaaacaagctcaacactataagccttgcatacagtagatacccctcaaattggcagccactgttttcatcactataatcatacactttctttacattgtcatctcaagtgtgacagagctgtaagagtgattgaactctaattttaatatatttgggatgctattttttaaaaatccagagagcttgataaacactgttagcttttactatctttaatgcttctctgtgactcactttttcttcaaatttcaaccctgaaatttagaagaagttgagggattacttgttgacttactattgtaactgaataaagatttagttgcttgctgcttgcggagttcaattaacaagagcaagatctggtagaaagaaaagtgactttattccagagctagctgaagggcagtagtgcagtctccttcctcagggtgccactttgcttccaggcagaaagcagaggcttttaaaggaaggcttggagtgaagggcacgcaggggagagggcgaggaagtgcagggtctatgtgacttttcagatttcttatctatccggaggtctcactagtgccatcatgggcagagtgaggttgtaaatggtggcaatctcctattgggatagaattctggatgtgcctggtttgcttcaagtttcagtctctggaacttctaagtaacacatagttagacagacttgctgtgttggaagtgtctggtggagagaaggtaaagattatactttcattcctaaacagctaagtaggtggtggggggaaagaaaaaaagttaaacaattgattttttcccttttaaaaacgaggtgctaagttacactattgcacttcatcttctaggaggccctggctccctaaggagcatggagtggcagaaaaatctaaaagtgcaactggatgtctaatagggcttttcctgttgctttggaattttatctaagactacaaaaccaataagcatacaaaataaacactgccaccttctacagagaagacctgagggacttccagctatttcttccagagaacactaagaggttcccaagcggactctcactcttccctcccagcactacagtcagctcatacaataatgagacttcatgggttaggggaagtgagtctctgggattatgaattataggtttaaagagagagagctttatgttttgcctctttcttaagccaagggagagggactccaatggtgccaacagtagacatcgtgcgacagtgggaggggagagagggtctgcaagaagaggagatgaacatcttatgccctcacaggtgcttgtccgtctgcggataattctttttttttttttaaggcggagtctcgctctgtcgtccaggctggagtacagtggcacaatctcggctcactgcaagctccgcctcctgggttcacgccattctcctgcctcagcctcccgagtagctgggactacaggcgcccgccaccacgcccagctaatttttttttttttttttttttttttgtatttttagtagagatggggtttcactgtgttggccaggatggtctcgatctcctgacctcatgatccgcccgcctcggcctcccaaagtgctgggattacaggcgtgagtcaccacgccgtgcccagataattcttatggcgtctcaatcagaggctccataaccgagtatgatcagagcaggttttctcccttctttagctttcatctctcttccgtggtcctacaacccagaggaagcagagagtgcagcagcagcaaaacaagttcggtaggtgatgcaagaactgccagaaccctttctccacatctttttgaggaagtgctggtcataatccatcttctgtgactgccttcaatctaggttcacctgcactgcacaagcaactatgtcccttcgagcatggtgtggcatgcatgaaagtcccctccttccctagatcctcatggtcttgaaaatttctccattggtctttagaatccattaactctatggctttgattctgggtgggatagtgagtccattttcatttctactggctactgtttccatgttccccgaagatttatggatcatctcaccagaattacagtacagcagagatggaggttagatgtctgtgttcatactaccctcctgcccagaaggatgtcccattttacttctaattcagaaccctaagagttaggccaagttatgttcctcccattttatagatggtgccgccaaggcatagagaaatgaagaagaaaaactcacgagactagttaagtgatgctgttctattttctagaccttcaattacctctttttataattctctgcctctactctgtcctagaactgcatgttgccctgaaagacccttgcctgtgggacccacaggcttttcagagaacacagagaccacctgaggctgcttattgcagagagtctggattcacttccaatccctttttgctctgggcttgaaaggcctcattcttacaagccttggcctcctcaaagagagaagcatctgcgtaacatggttctccctcttacctgagactagagacaattataaaaaggacaattcccatcccccttaccccgtgccctatatcatgaaataccctcacagctacacgtcgaggactccacaacatgcacacagccacatgtcttaccttctcagcagtgatcagagcttgttgctaaaccaccactgtctaagaaagtacacagagtagcagctagagaaatccttcttaaaacagggtccatcatgctacagtgaaggaaatcaggttctgacatcctttccccaggcctaagatttatttctaaataatgtttattaaagggcccctaagttcccggttctctgcaaggcatataacttatctcactgaagctttccaacaaaatggtgcattataatatcccttagatggaagaaaataaattgagtcacagagagatggtgtaacacatcccggtcacccagccagcaagtgcccagcttgaaataaaaaccagattatttttggctctaaagcctctatccttttcattcaattctaatgactactctcacttcattgagcccagcaatttgaatttatcttttttatccccctggagaaaagagagaggtagacacatatcactgcaagtagaaatccataaatatgtaaataaaatagaacatgcaatcaaccctcaggtggagggaataggaagagagccctccaaatcaacagcgtatgtggtgtctctggctgtacaaagccacttttcacttggagagctgggactccgcaagactacaatgaagtgggttcccaggcaaggggcctttgattgacacgcaagggggacgggctaagattacgtgacttgctggattgttgatttgtgattctgtaactataatcggagtggcctggggtctgcgtcaagcgaagtttggggggataaaagaaagcaatgtctggggattaagtgagacaactgagtggctgaagacctgtttttgagatgaggaggaaaacctgggagcaaaacttacaagtgggtgtttcaaggaggcctatttgagggtaacaatgaggaagagcttcttctatctaatgctagatgatagtcttaagacaccaacaagctggtacccaagccattgaaagtggtacctgcaggagaggtacagggccaagttggacccatgtggtgtccctatctcttgtcacctcacctgctttctccagttactgacctcggcatccactgcccttggttctcactgtggactcccaatagttaatgctagcagcctgcctactgcccccactcttttaaacctaatggacactctgtgtataatccatccagagctgtacgataaccaagctaacactggatagaggataatagtcaccacccgagatctccagcagtgaaatggtctgccatggaagagtgtaaacttcccatcagaggcagcattcaaggtgaggctgggtgggcaacacacagcaattctaagacccaactcctatcacagaaagtctgctgttggggatgtgctggaggaaaccacacaatgctctagacaagagagtctctgagatcccagaccacagcatgaactctgaaatgggattttccaggagatgatgaacaacaaaagaatatgggtccaccttcaagatgccaattagttctgagaagtggacaaggaagacttcctgttttgatataattattcataatcatagcatccataacaatagcagcaaccaataacactttggttcactataggcagctaaagaacattttgagtttgatatacatgatcgcatttgctctcatacctatatctcatgaaagatggtgaatgattaaactaaggaaaagaaacaaaatgataaataaaaatataagaaatggattatctcaacagaacagcatgaagacacagacttaaattgctttcatcagtactaagaagtccctttgatcctaaagtccaagtgaaatcaggtagtccgcatggaagaggcagttatctgctgatctctcctgagctccagatttatatattcccatcacctgctatacatcttcacctccaacacaacatattcagacctgagctcatttccttttgtgtttttcggctcagaaaattgtttcaccactgtgatggttaataatgagtgtcaacttgattggattgaaggatgcaaagcattgttcctgggtatgtctgtgagggtgttgccaaagaagattaacatttgagtcagtggactgggaaaggcagacccaccctcaatctgggtgaacacaatctaatcagctgccagcatggccagaataaaagcaggcagaacatgtaaagactagactggcttagtctactggcctacatctttctcccatattggatgcttcctgtccttgtacatcagactccaagttcttcagctttgggactcggactggcttcctttctccacagtttgtagacagcctagacctcaccttgtgatcgtgtgagtcaatactccttaataaactttcctttatagatacatctgtcctattagttctgtccctataaagaaccctgactaatacaaccactcatctctcagccatctaaactgaagcatgggagtatcacctttgactccctactcccaaccccacatccctcgattcctatctgatcatctgtacagtttctggtttaactggctgggagtcttgctctgaactccagcctactgggctgggatgctgcgctacaggcaaacacttgacaatctcccccttaagggttaaggaggaggtatcctttgggttaagggaaggatagccttcccttagtaccccagaattttcttaatcagtgacctctcaaaactggcagagccagaatgcatccccacctgccttagctgaattgcctctctagcatcttcttgtgctacgcccaagcttgtagcctactgctgccaagtctctgcctgctactagcatgtccttactaagccaacctctgccaccagtgcctagcacagaatttggcacaaagaaaagactaagtaaatgtttgatagaaaggagtgaaacttttgtgtagtagttattcattctcagctgatctccatagtcaccaacctccttactacccaatgccactctcaagaggacacttgtgggcagaggaggtccccagggctgaagactccatcaagtcctgtggtgaagagtttctctggccaagagacctagcatttaaccgattggtgaccttcatccaactattctgagtctcagttttcctcccatctacatctcagagctgctgcaaagaccaagctatggaatgaacatccttccaaagagccatgttggcttgtcactatacataagttagtgtaaaacttgggtatgaaatgacatcactcagtggaatccttacagcaaatttctaggctcaaccccagaatttctgatttattacgtcgggggacaggtctgagaatgtgcatttctaacaagttcccaggggaatatttgtcttaatccatctaggttgcagtaacagaataccatagactgggtaacttataaacaacagaaatttactttttatagttctgagggctggaaagtccaatatcaaggtgccagcagattaagtgtctagtgagggcccatttcctgggtcctcacatggcagaagacatgaaggagcattttggggcctcttttgtaagggcattgatctcattcatcagtattctgccctgatgacataattagtacccaaatgccccacctcctaatatcatcatttcgagggttagaatttcaacatatgaattttaaaggaacacaagtattcagtctatagcaatactgatgctgctggtcgagggaccacactttgagaaccaccgcccaagatgattctaagaccatttctctttccatgctgacgctgtttttcctccatgaagcatgctatttcaatgcttgcctttatgttttacctttttttgctgttttgttggaatcctaacccagcctgtaaattcctctgggcagaaattataccttccactctacatactctctcactttctgttttgtaaaataatgagtacatttccagcgtgattaataatagaataggaaaaggaggaaaatctcagactaccaacaccaataaacaccacctacaaatagataccagccctggaattctcttaaaaattaattacgaggcaaaaaacattccaccatcagtggcgatgcaggaaggaagattatcttcttgatgacacattttgtaaaatgtgaattattcaagattttagctgtaacttaaacaccaacgttttttaaaaataaaataccacaattgcattccaactcataatttttatattgatagccagattattgtgttttcaacatgtaaaatccattacacagtcatggcaacagtttgcaatagactgtaaatctttattgagatgatcatcttgcgattgaatttcaaaatgtattatatgatcatcagcaaataagtccacgggggctgctaaagtactttgaatatcatttataaagatcaaaaaccctggaaactcttacatttaccctgtggaaagagagaagtctcatcagcaggatcaaatcaattatttttatggatgaatattgcattgcaaagctgagataaggtattacccagtttagtaacatatcattatgtccttttaaagtagtaagtttcataatcaggtttcaatgaggaattttaccaaaggcctgttttgaaaataatcaagaaaatggcatctctgttcagcatagtggttcaataaccttacaaggaatatttccaagcaacaaaaatacctgggttacatactaccacgatacaccactgagatacttaagaatggttacagctaattccactacaactcttgctttgaaaacgcaaatttgttccaacccaattaatatatgaaagggcaatttgagcacaacacgaattctgcatttgcttatgtgtgattttgtatgtgagaaacattagtgaaggagaaacctgcacccagcagaactgagccacctacgaatacatgcaacacacacagttccaacccctacctggcccgtcagctcactgcctgtgttctgagccacacctttttccccaatttcagacagctttccttccaccacttcacagtcactcacaggctgcaagtcactcacaggctgcaacttccctgatgcccacttccacagcaaacttcaggtctttttcaaggtaacataccatctgtgttgagcatcccttatccaaaatgcttgggaccagaagcgtttcagatttcagattttcttgaatttcagaatatttgcctatacctaatacgatatcttggggatgggacccaagtccaaacacaaaattcatttatgttttatatatatcgtaggcaatcttacataatattttaaataatgttgtgcatgaaccaagtttttgtatgtcgaaccatcagaaagcagaggtgtaattatcttagccacttacgtggacaactctgtgcttgtctgtcatcaccataattcctgactccaaatgtatatgctatcgataagcaatcatcttcttaagcttattcacacataagtgcttaacagtaaaaaagaataaatgatatgtcattaatactgtgaaatattaatgtgttcaggttaactgagcagcacagtagactcagcagatacctggatcagctggtgaatgtcagcaacaaacatcctggctttcagtcctctccctgtgatgttgtgctttgatgaagggttcctatacaccacattttattttcttaggtgagaacaaacatcagaagcagttgaggaaccaggaagtggatcctctagggataaagaggcattctgctggatggcttttaaaaatgtttcctccagagtcatctgcctcattaacaatgatttttgtcttagacgtctctgattttataaattgacctggtttcctgttctgctatgaatgcatactgctccagtccttccataagctcatcaccaatgcttgccatgtcatctacaggcactttttctgcagtgttaacaatgtcatcttcattggtggtatcgtgttggcactcagtaagtttcagattctggagcattttggatttccgaggttcaggttaggaatattccacctggatggatgcatttcttagccatttcacgtgcataaaattgtgccaccagttttactagattcccctcttttttgatgtgtcactaaggaagtatgaatatggcccctagccccattttttccataatccctgtggttttcatttcgtaacttgacatagtgtggtgatttttaggcacctatatgtcaagtcatggcagagctgtatgcactttcccttgctgtttgttccatggttcctgtactgatgggtccttcccctccacccagatgccctcagtgactcctctttgttttctgaaacccatgctgcctgctcccctgagccacacccgcctccactagaacatccccagctgtatatacaatgctctctctctctctctctctctctcttttattcatcatgatgtggccaaaagtcaaaagctgagagtcagaaaatctaagtgtaattcctgaccgtaccactggccattctatgactttggacaaaaagtttaaaagtattgagtctctattcctttgtgcatatataaaatgtaagtacttacagcaaaagtttacttggtgtgaaaaaaagatataacataaataaggtaatttgcaacaaataaagagcaagttagtttaatttcttgagttgcatccagagccagatcatctcagaggtacagtgagacacatgttgttagccaatagcccctgattagaaatgcagtagaagccaggaggcctgggacacagttggatccagagaatctctcccctcttagacacaatctcagccagcaaactcttacatggcatccaggaatatcagagagacaggtgtagtcagtaacccatagagatagagtggaatccagaggaccttcagaggaatagtcccaacccagactcttaggtagggataggagcctccaggggatacagaggcaggaagctcttagggactaaggtagttccagaaacaattcagagatactgtcagagccaggaggcatttaagacatggttggcaacagaagcccctcggagacaattctagaaccaggagccatcaagaaaattttcaaaaccaagggtcacaggcccagctcagggagcctcaggaacaatgttagaattagaaactcattaaagatacaaccaaaaccagaagcccccaaggacatagtctaaatgaagcgttcacggggcacagtgagagccaggagccctcagagacacaaccagagccaggagccctcagagaaacagagccaggaaccctcagagaaacacggccagggcccccagagacaaaaccaagagccctcggagaaattattagcattagaaagcctcagacatacaaatggcaccaggagttctggaagacacagagccagtgtgtctcatcagaaacactattagatccaggaacctcccgtgacccagctaaagtcaggaagttcttagaatcacagtcagagctagaaagcccctagaaatgcaaccacagcaagaaggtcctctaaaaaacaaacaaacaaaaaaaaccccaaggccttgatcctgtttatccacaataggaagcacattcacattcaaagaaaattcggaattatctgtcacaggaaggcaagaggaaagccagtcttggcaatagcacagcctctcataatggagcctgggaaaaaaaaaaatcttacctgcacacttggtcctggtggtgaggggaggccctggcggtcccgtacccccctcacctggtcgtgtgaggagcactcggatctcatactcaacatcggggtccagatgccacagcttatagttgggagagtcgactatgtgggtctctgcccacgtgcctgtggtggtgcgatattccacttccttcaggatgatggggccatccccgatgatggagttggcatttggcttgatccacaggtatgtggcccccacagccagcagctctgggggagcaatgggcgtgggaggctctgtaagacaagcaatcaaaaaggactgtcagattcaaatgatttacagagcagactacaagcacatgacgacaagggacagaattcttgatgtagccacaaaaaaaatagtcagaaacccctttttgttttattttattatttttattttatatttttgagatggagtcttgctctgtcattcaggctggagtgcagtggggccatttcggctcactgcaacctctgcctccctggttcaagcaattctcatgcctcagcctcccaagtagctgggattacaggcacctgccaccacggctggttaatttttgtatttgtagtgcagatggggtttcaccatgttggccaggctggtcttgaactccagaccacctgaggtgatccgctggcctcagcctcccaaagtgctgggattacaggcatgagccaacacgcctggcctgaaaacccttttaaatcccattcatgccctactttaagggtttgcatgtaagtacctgaatcagtatttcttcaatagctatattcaatgcctaccttatctccttcatttaaagaaatgaaagaaagaaggccatgtgaggaaatggttttcccagaacacagcaaagctgctgggtgaatactctgttttctagcctcaaaggaaaacctgcttttgctgaagtaaagtttggcacaaaaccaggggagcctgaggtctataaacatttcttacatagaacacacagattgttagtgaagttctttccaaaaagtgatatgagcctaagtagaaaaagaatgatggcacagcaagaattcagcttctgcctcaaccccagcaggtttcttccagcagagaaagtcatgggtcacagcagacccagcaggaatgaggggttaaaggaaaagttgtgctgagttatcgtgcatctactctgtgctgccacctctcttccactgagttccacgcagtcagctaagtagaccagaggttcagcaggcttggattgtagcctcttccttgcaattattagcccatggcaaagctacaaaaattaacacttaccttgtacttcttatgtactttaaaatctcacacgtatcattcatgtaattcttgggacagcattatcaccttaactttaatggggaaaaaaaaaaaaactgacaacctaagaaatcaggtcacctaaccaaggtcatggagaaggtagtgtaggataaaacttatatccgcatgccttcctggaccaacttgcaccaaggaaagctgtctgcctcttaatactcatctttaaaaaaatcaaactgaatatatttgttatttttatttgcagtaaaaatggcagaacaataaagaaaatggaagaaagagaaaatatgagaagaaatggaagaaaatggagaaaaatggaagaaagagaaaatatctctaacatccaacatagccatttttattcttccatgtccattccaatatttatgtactgacacattttttgtgttgttataataacacatagacccaatgtagattcatttttcttccttcacttatattgtaaggattttttttttcatatactgcttgagctttatcatcattgtctttaatatttgcataacaatccatcaggttatcacactaactattctctgattgctggacccatgagttgttcatgttttgctatggtaaataatgctgcaatgaacatctttgtgcaaagacttcagtctgtcttatctcatgttttcttagaaccaactgcgaggaatgggattatatgtcaaagggtatgaacaagaggaaatgaagagtagaacaaggaagaggagaaagggcaggcacagaggaggcatatgagggtagaatacaatgtgcatttgtttgagaatatttcacttatagagggcctctgggttattcacatggatagaaggcaggtatacattttagcttggaactcaggtaagggctttgagatagagacgcactaagcatttcccttccaattaattacctagaagcaaagattctctagaaacagaataattgctatgaaacaggggtggacaatattttctcagtgtgactcgaagcaaatcttaagggacaactccagattgcctctattatagcctgccatttggtcagagaaggaaattaagcagattagtcaagctagatgcttttctttacaaagccatggaggttattactcaagaccttgttatctcaaaggtgtttgcaaattgatttttggataatttgttccaggtagagaagctaggttggcaggcagataatttctaagctcatcctttgtgcatgttaaatatatggaacctttgattgccattatcaactctccagagctcccatcagtctccaatgaggccccaggggtgatattttgcagctctgtgatgactctgcccaattccttaatataattattcacagactagacctctacagaattaagagttgcagacttcaatagtttggaggctgagtgagtggccccatttagttcttttccattgacttttcaccatggttttctgctctcctatttcagacagcagtattcaattgctgaccaccagaaagaaaataaagtattaaatctttccaaatggttagcttcttttcatgtatttctaatggcatgtgcaagtatagtaacaaacatccccttgagtatataaatgtccctatctcaaatgacttgcgacttcacacatttgtgtgcagattagcctcacggttatctctctctccatcccctcaagagtagaccatgtaagtttatcacggtgtttcctctatctggcaccaaggaagccatcagattattgtgtgctttattctttcttttttcagtgatccattgattcataattggcattgtttagaaggcacaggtactggtggttcaaagagagagaagcaaaaatatagcacagaatgtttttggtaagcagcacattattttaaaaatacatagacaaaccctatctatttatagcagttctctatctctaagatgaactcttcaagaagacagtataggaaatgtacagggccatccagtccaatggctagagtcagcagggaggaaaaggaaacccctgtgtatctcatttgccagacagagcactgagcgcatgaaatttaatgcagccaagtaaatcagtgataacaaagtgtagtaaagtcatgatgcgggtggcagaggcagttttgaagcctgtgaaaggacccaatctggtctagaggttagggaagctcttgcagagagcacttaggggagtgttctgctgggaccactcatgttgagtctatgaacaaagaaaaattcctgggggtcccctagttctcagttgcttgggctacactggtcaacaattcaaacgatgtgccctggacactcattcattcactcgttctatgaatgttgagtccctgctgctggtcacacactgtcctaggcacagacacaatcttggctgcatggagctccccttccagccttcactcgaggattgacaaagagaagtcaggagagaaggaagctgactcagaagctgttgagaaggagggcattcgagaatagagaggccctgggagccagacctaggtaagagcttatggatccataaagggatacacatatacacaatggaacgctgctcagcaagaaatgaacaagctgcagacacagacacacacaacaacatgagtaaatctcaaaaaaattcatgcaaaagaaaaataaaagaatgcatgatgaccccacttatgtgaaaagttcaagaacaagaaaaactgctctatggtgataaaagccagaagcatagtgacctgaggggcaggtactgaccgggacagagcctgagggaagtttctgggatgttagaatgttctctatatattgatttgggtaattaaataacagaaatcaaaatagtgttactataagggagatgactgcctgaaagaaggcataagaaaaatttgggaggttataaccatttctgtatcttaactggggttatgtaaaactcattaaactgtgaactttaaacagaagtatttttatgcatataagtgataccttaaaagttaaaaaaaacaaaaatatggatatgtgactcactggatgaagagaatgccactaattacctgaaagggaacctcagaaaattgggagaaaatgagcctttactcctataccattccctcttatcagcaccatcagatgcttgaattcctaacagtttttcaaacaagaggttgttcaggcacacaccagtttcttatccatgaggcttttcacttctaacacaaccaatgccctcttaacagactccacaccatcatctgtgcaaagccaggagtaagtgtttaacatctgacagcaccctctgctcacaaagtttgcaactaaattaaggaggaggaagtcttgccttcatggagctgagggctgagctgggagatgacatcagtgccttccagccaggcatcaaagcgctgcgaggacaaggatgccaggagccatccatgagacctgggcagcagcggccctgagcttccaaggctctccttcaacatgtagatggtgaagtgaccccttcctgtaattctgccacatcctcaggcatcaatctccagaacaattctgtctttcttttccctgctgtgagcacttgtaacagtttgactccctagaaattcctacagagagtaaaagtgtttcaaatagctggagatggagctgtgcgcatgtactgtctgctctagatagaaatcaaacgttttgagaaaaaccaaacgttactaagacgtgaagtgagccttgatatgattaaggtgagtgtaacctagcctccaacactttacaccacacgtctcaccccacctgatcacccttttaactgcattttctattcactgaccctccaggtctgtgggaatgcctccacccacccaaccctagccaccaacacaaacacattcatacacagacagaaacacggttgtgccattctcatttccagacttttgtctgtgccatttttcccaactagaatggctttccttttacttgttttttttgttttgttttgttttgttttgagacagagtctcaccctgtcacccaggctggagtgcagtggtgcaatctcggctcactgaaacctccaactcttgggttcaagcgattttcctgcctcagtctcccaagtagctgggattacaggcacctgtcaccacgtccagctaatttttgtacttttagtagagacgtggtttctccatgtttgccaggcaggtctcaaactccttatctcaggtgatccaccctcctcagcctcccaaagggctgggattacaggcttgagccaccatgcccagccttcaattacttttaactaaaccatgcctatttttcttttcaaaactgcttcatgacgacttactttcgtgtagcacagggctaggcacagagtagatgttcaatgctgattaaactttctacgatttatgcgcaacactgttttcatacaataatggactgaggatcaaaaaggactaccttggggccagggttcaagctttccttgaccttggcttaccactagccagatgtgtgactctactcaatcttcatggtcctcaaatttattttaccttgacaatgaaagattcaagtcataaaagtccctaaattttctctaccaagggccacagggattctatgtgtactgaatgactaccctaacagtgagcaatcggcagtagcccagccttctcattcttccctggcttgggctcacagtccttggacacaacctaagtagatatagcatcaaatcctccagtaggtgccaatcagaattagtctttgttggctgggaacggtgactcattcctgtaatcccagcacattgggaggccaaggcaggaggatcacttgaggtcaggagtttgagaccagcctgaccaacatggtgaaaccctgtctctactaaaaattagctgggcacggtggtaagcacttgtaattccagctactcgggaggctgaggcaggagaatcgcttggacctgggaggcagaggttgcagtgagccaggatcatgccactgcactccaacctgggcaacacagcgagactctgtctcaaaaaaaaaaaaattagtctttgtgccctaaccaaacatacagccagtggtcaataaatatctgatgtcttacttaaatgggtagaaaaaatatttgataagttttcccaaagtgaaaggttgagggtggcaacaaagagatgaaaaagaacaagaagtacgatgttgtagagaatactgaatgcacctctaagcaaaggattggaagtatttagagagaagacatcaaacaactgacagaaagcaacaatcaaagacatatgtaaagaaaacttctctgaaatacccaaaggcctgagtttgcagactctgaagagcacagtgggttccaggcaaaatcaatgatgagacttcagcttaagtacatactggcaatatttttgaaatataaaactaaagaaaaattcccataagccttcagaaaaaataacagatatctatcaaaacaaaataaaaagactaaaaactctggttccagactttatcattacagtttcaaacactgggatgtgatgaggaagaggatgatgagaataatcacaaataacaccatggggcagctcccatgtactgcacactttcagacacctctgactgcccttagtgttctacagtattgattcatttagtcttcacagcaactttatgggtgggtagatacccatccaaagtcaaacagttagtcattcaaaatccaggactgaggccaaggcaacatgcccggggtctgcactcctaaccattatgataaagacaatggtacattatgataaagacaatggtatacacaaaaggtcttaagggggatgtttccagtcccaagagttttataggaggttagttgtggtgcattttcaaagccagcagaaaaaatgctctcagtttctgaagaacgcagagaagaaaatgctatgtgcatgccttcccttagagaaaaactgcttgaagatttaccctagtccgccttgtgatgaatcaaaatcatgacctctagcataggggaattgtgatataagaatgatcagtcctatgagatggttagctaccacaagaccctcctttctcagatgtgagtctagaagaggagcatgatcttgtgccagactgaagtgaacacatagcccaatctgtaagaaggggcagaatggcatgcctttcatccacacagcatttagggaatgcttaaaaacaagcaatttcattatgaacggttaactttagcttcggccatcatcctgaaaagggacatcataaattcctatgaaaaagtctctccttcactttgctgaactaaattcaacaaacaaatctcatctacctaagcttaaaacatctagatttaaatacatgaaaacgctgacgtttttcttagggttatgagaatataggtactattttttctttattctgtttcttatttgatttttttacaaatgcctagtaaacctgcatcagttgcttattataaatataagcatttgaaataggtaaggtttttatatatttcaagcttttacatctggatgtgacctctcttgcagttctctgctctcaatcactaggagtgtttagcagtcaatctcccctcctatctgcccaggtagcaggagtcaagaaccacgattacatccattttcccagcaagttcctcaccaatagttcactaacaaggagacatcctggctacctctgggaccccctcaaagacctccactgtgagttttgacacttgactttcagataatcctctaatcattgcaaccacacagtagtttacctgtttcctcatttttctctccatagtgacaacacaaagcagacagtactacacccttattacagatgaggacaccaaggttacctagaaagcagctgtgtcaataccgcctgctctgtggctacaggcattgcacttcccacctacccgcaagcccaggtgttaccactcccaggagcagcccttacccagtgagggatggaagttggtggataaacatccaggtttccttgacccctagtgggacaatggggtggctttattcagtcttttagatggtcctgggtgggactgagcaccagatatcctctagcacttccagctcatagtgcactcttttttttttttttttttttttttttttttttttttttttttttgagacagagtctcactctgtcacccaggctggagtgcagtggcgcgatctcagctcaccgcagcctccgcctcccgggttcaagtgattctcctgcctcagcctcctgagtagctagaactacaggtgctacaggcatgcgccaccatgcccggctaattttttatatttttggtagagacggggtttcaccatgttggccaggatggtctggatctcctgaccttgtgatccatccgcctcagtgtcccaaagtgctgggattacaggcgtgagccaccctgctcagcccatagtgcactctttaaggggctttctttcttctcagtctcacttcgtctcctgtttaccagtgttccctacaacttagataaactattcgcaaatccatgctaaaggatctgttttttggggaaatccagtctaacatattatgaaaacgagggaaagttacttaacctctttgtgtctaaactgcctcacctgtaaactggggatatagtaacatcttcctcatggtaattgccataaagattatataaattattatagttgatactttagaacagttcctacacgtaacaagtaaactgtctttgctactaatatcatcatcctcccaaccagccaccgatgagccattcagctgtcagtgacagccttaactgatattcttattttgtgcccccccaacagagagacagaaagatcccatcaaacgcattccccttcctgtgtcaggatcaagacagtctacagtcatgtcagtgtgtactcctgccaaaactcctaccagcaaataaatttaagagctcagcctcagtctacttaacaacatcatgttgcaaccagtgaagtcattcagaaatgcataattcaataacaacttagcaccagatgaagttttatgatctgcaacactctgtctgccccggctcccccttatcccccaaaacctcaacattttcaagattactctttgctgggccacttcccaaaattaagagcagagtaaacattctagaagagccttcctttccttgcctgctaatcaggagtcctcagaaagcatgaatcaagagtctgtcacctccaaaggaggggctaggagaagctggattctaaagctttggaatcaaaggccatgcttcaggagcaccttgttccagggcagcatgggttcacaaatgggcacccttcactcccctcccccacctcagccaagcagccctgctatgaagaatggggtgaaagaaactcttgccttatccagtttggatcttaagagttccagagacaaccacgtctgtacacccacaggatggtgagagctgttattattactgtcacgcagcaaggacaaataacattctcataatgttcactgcgtgcctggctctatttcgggatttacatacaaattcatttattcctcatatcacaccggaaagtaagtactattctagtatgcatttatagatgaggagactaaaggagtgtgctagtattcagctctggtctttttgcctcaagcccaccctgttacatcagttatgtaattctggagctgggaccccactaacaacatctctaaactaccttgccagctggctttggtccagtcctagtgatgggagacttcagatggagactgggatgctggaagaaggaagaagatgctctctttctgcttcaaggtccttgtagcatcattccagcaacaggggctgctacgctccaggccttcatcttttctggtctttgtagcacccatggcacagtatctttctgaaggaactaatataacctaggccatgccccttacagctgcagtacaatctgtggggtctccctcctcagaggtctcagaatcagccctgctgtgctcctcctacagacttctaggtaccataacccctcctattccattttgttaccccagccccaggtgtggtcaccacttcctgccatttttggctaccttagcgtcccacttttgcactgacagcctttcatcactgtgtaatggattcccttcaataaaaaccctctgtttgaaatacctggtgtgatttagggtttccctcctggactgtgatttatatcaataggtattataattatctttatttttcacatgaggagaccaaggtacaaattgcccaaggtcatgtggctaattagtgagtgtgctgggatactcaggctgtcttgctctagaggccatgattttaactcacacagtgagctgatgccccactgttctcagcaccctggtcagcgacacagtgaggcaggtacatgaaggctgggagatatcatattctgcctaactaacaagtaatgagggctgactctgctatgtttggggatgtggagtcaaagcaaataactgtctctaccctggaggagactaagagactagggaaggatgcagaaaccaatgagctatagaagaaagtgatacaggctgggaagtggcaggcccagagtcctgtggactcacacagttgtgtggtattgatacagacagaagacagggaagcactgggtagaagagggtggttccccagtaagggccccaccctcaagcctgaagacccacagagctaagtcagcacagacatttctgttttcgcacccaaaaagttgccttttggcccaccatacctccaatcctgtccccatataaacccaagaccttagtgggcacacatacaagtggctgaacgttggaaccagcagaccagtgacaatggaacaatgtggcagagaaagacagaagagaaaggatgtctggacgctgaggggggttcagctggaggcagtcagataagaatctgccactgggcggcccaactccaggggaagaccaccttcccactccatcctccccttctggctccccatccatctcactgagagccacctccacggataaaacctcgcactcatcctttgagcccacatgtgatccaattcttctggtacagtgggcaactgaaggagtgagccacacccgtttcacatcctgcaagggagataagggaaatctctcatttcagtatcatacacagaatagtggtcccaaaagatgctcaattcctaatccccaaaacttacatagactccaaaacttgtatagactctgaagctgtgattaagttaaggatcttgagtagggagcatatcctggatatgtagtatcctggataagtgaagaagggaggcaggagagtcggagagagcgattggaagatgctatgttctggctgtgagggtggagaaagggaccactaggcagggaaagctggtgacgtctagaatctacaaaaggcaagggaatggactcttccctagagtcaaaggaacacagccccactgacccattttagacttctgacctccaatgctataagatcataaatttgtgttgtcttagaccactaactttgtgattggttacagcagcaatcaaaaactaatacaaggagagatatccaaattagatggaggatgttagggaaggcttcctagagcaatcaaatcatgatcttggtcttaaaggaaaaggagagtctaacaggcacaagggtggggttattcacaaagacaagactgggtcatgcacggatggtatatcctgctgaaacacaggtgatggggagcaggggtggggggccagcaaaaaggcaatcagagaggtcaaaagtgacctgatcaggaatggtcttcatcctgaggctgtgtaagcagtggtgtcacgtaggcacaagagttttagggacaactcctctgagtgcacggtgaataatgggtctaagggagagaaacagacagggggaccaataaggaagttgtgtcaattacattgaggaaagaaatgatggaggcataactcaagtaatggccacggggctggagaggcagaggcagaggaactaggccgagggttgggttgggagactgaaaggacaggacttggtcatggattgaatgtaaggagcaaggcatatggaccagtacaaagctagtgttcaacatgctgggtgagtctccccttgacctccacaatgcctgcgcagcccacataagtggaagtctacctcaatttccctgtgcagtaccccagtactctatgctagcttctccaaactatgcccaatacacttcatccctttgcattttcatattcactttcacttacaaagggaagtgaggtgtactggaaagtaaaagatcactgggtcagacagaggttgccttgcaatctctattatttaatggtgtgacattaagcaagtgatataactcccttgtggctgagtttcttcccatgtaaaatcagggtcatggtcatacctcactgggtccttgtgaagatcaagtgtaagtgcctgaaaaatgacaggccctacataaacgtgagttattcctttcttcccatggctattagctttggacccctgcactggtctttctccccattccacagccttctcctgtaatgggccattcagcccagcgcctctagcctcctgagatgccccctctgagcatctgagctctcagggcatcttgggctcatgcatcacatgtatcacgttcgataaaatcaatgtcagctttatgcatgtggtagccactaatctcccaccaggacaggcaactcactttcagaaagcactggaggaaaaacacagtagctgccatagcagaacaaatatgacaagatgacaaagtagagagaaagggggtggtagggagtgagggaagaaacatgcaattcagggcaacctgagtccaggaagcttcgtcagttgctacgctaccagccacagaaagaaaggcttacgcagaaggtgtctgtggctttagagatattgttattttgcaaattcttctccttggcctatccctatgtgcaaggggggagatgcataattagtctgtaagctgctgaaatggctagaaatgactagaagtatcgactgctctgaagtgtcaggaaggggtgtccagatggattaagaggcttatccatagagcctactcagtttgtgggaagagtttaagagatgacaccctcccttatgcaaaggaactgaaaaacgagcttcttccaaatcctccctcattcccctagggctgcctctgcccctgccgtatcttgcctgaagagagacttagcacagcctaactcactgctctttgggaaaggacttcgaaacaacacaattctgcaaggtcccatagacctctgtccctgtctccaaaagccatgattctgactaagccagatggacgctgggctccaagaatagaattagtggcttcatgctgttgtctaccacaggtcactgcctctaggtgcttctgtagaggaagagaacatgaggaaacaggaaggaaaaggtaaatatattgtttatgacattgcaggcactgttctaggtatttctaacatcttattcatgtatttctcaagcataggcccagggaactcaatgacatatacagtgatttccaagggcccatagaaagcaagtctttagctagaacatcttggaacaaaatcctgcttgaaggtgttgggtaggtttgaattttaacacacacaaaaggtttcaatgaaatatcacctttacacaaattatttcagagactccaaagagaagaattacttccaaacttactttacaagcccaggatagctttcattccaagacttcacaaagatatcacatgaaacttttaggccaatctccctcgtaaacacgtaaactaaaatcctacatattgtattaccaagccaatcctgtgatatataaaatgaataacaggttataaccacattaagtttatgctgggactacaagattgatttaatattagaaaatcaatcagtataactcatcatattaacaaactgaaagataaaaatcacatagttgtctcaagagatgctgaggaagcacttgatggaaatcaacagccattcatgataaaacttttagaaaactagaaatagaaggaaagtcctataatctgacaaagggtatctaacacattactctaacatcataatcaatggtaaaatactacacacttttccctgatttccccaattctactggtagttttagccaatgcaatgaggcaagaaaaagaaataaaagaaataaatgttggaaatgaagtaataaagctttcattattcatagactacataattgtgtgtgtagaaaattctttaaaaatctcaaattatgataaaaattaacaagttaatttagaaaagttccatagattaaatataaacaattataaaatgaaatttaaaaagtgccatttacccaatcaatggtaatagacatcataataatggtgacctctaggggaaggagtagtcgactgggaagaaacatgatgaaactaggtaccacaataatttacaccttgatttggaagatggtaatatgggtgtacatgtatatgaaagacattgagctatccacataaggttaacgcactttatgtcctttactgcattctgttctacttcaataacaaacaaattgaataattacttacaaaagcaccagcaaagtattaaaatatctggggatgtatatatacctatatgtgcatttgtgtatatacatgtattcttcttcactgaaaactgccagacattactgggatacatttttaaagatccaaataaatggagagatattccatgctcatgaattagaagaatcaatattgtaaagttgtatattctccttatgttgaagtataagctatcctaataaaatatctgtcaggctttctagacaatttgacaaacttattctgaagtttatataaaaatgcaaaaggccaggaatattcaaagcaatatttaaaaaggaaaagaaagttagagagcttaccttttaggaaattaagatttattattaagctacaataattaagaaaatgaggtattaagctacagtaattaagaaattgaaaaacagttcaagaaacaatggaggcaagaaacaaatccacatattgataatcacttgatctgtgatacagctgacacttcactgtggtaggagaagtgtattctcaacaaaacaattaggattatttaggcatccatatgaaaaaataaccttcaacattgtgccctactttatactataaacaaagtcaattccagggtactatagacctatatgtaaaaggtaaacaataagatttatataaaatagaatgtttctgaccctggggtaggcaaactataatccataaggaaattaaagtggaccacaagggtttctcacgctactcctttagaaccacaaccacctccctccccacttccccacctcatcattcatccctgggaaccaccaatctgttttctacttctaaaattttgttatttccaaaaagacaatatataatctcttgggactgtttttgtcacctgccatcataccctggaaattactccaggttttttttcttttattttattttcttttttttttttttttgagccagagtctcgctctgtcgcccaggctggagtgcagcggcgcgatctcagctcactgcaacctccacctcccaggttcacgccattctcctgcctcagcctctcaagtagctgggactacaggcacccgccaccatgcccggctaattttttgtatttttagtagagacggggtttcactgtgttagccaggatggtctcgatctcctgacctcgtgatccacctgccttggcctcctaaagtgctgggattacaggcatgagccactatgcccggcctagtccaagtttttgtgtgcacggatagttcatttatttttgttgctgtgtagtttacatgtgatatacatatgggtctattgttgtgttgaatgttgtttaaccattctcccgttaagggtcatctaggctattttcaggtttttgctattaaaataaaactgccatgaacagttatgtataggtttttgtgtgaacataagttttcatttttctggggtaaattccttggagttcaatctctgggtcatatggaattcagaactatcaaactgctttccacagcggctacatcattttacattactactatcaatgcatgagtggtccagttcctcacctgtactactattgtcactatttctttttagccattctgataagtatgtagtgatgtttcactgtggttttaatttatactaccttaatggctaatagcatggaacatcttttcaagtgtttatctcatctgtacagcctagtgcagcttgatagctggttctggctggggtcactcagaaggctgcaaacaggatgtctactgtggctacagtcctctcagggcctgactaggataggatctgcttccaagctcacagagctcctggctgtcttcagaagacccactgcaaagatcatgcatggccaggcgggggtggctcatgcctgtaatcccagccctttgggaggccgaggcgggagggtgaaatatctcatcatatcttttgcaaattttctaattgttttgtcattgagttttaagaattcttgatatattctagacattagtcctttgtcatatatatggttggcaaatattttctttcactctgtagcttatcttttcatcctccttgcctgagctttcacagagcaaaaattttaactttaataaggttcaatttatcaatttttcagttagaaatcatgcttttgatgtcaggtctgtattaactttttacttttaattatactcaaatgtatcagagctcacaaatccattcagattcctgatgaaatggtgttcagtcaaatatttggttcacaaacacacaactacgcttgattctatttcctaccatagagtttctgaataacagatatgctgaaaaatatgtctggattgttttgaaagttttagtggtatttattttttagaagtttgatattttaaaaattatgttttcggtcaggatgatgaatagttaatttaaaataagaaaattaaagaatatactcaaaactgtggaaaagatggaagaccatacaatttggaacaacctacaaactgggaagcatgtatccaacacagcactgtccttcagagtctcttcattgaacttaacaaggaagaagatgggatcactaccccaagttcaattaatgattcattagtaagcagctgtcaatctggaaaatgtaagatagacttagatacttaatatgtgacttttactactgtaaatcttcaaagggctaaaacttgatatctctcatgcaagaaaatctggcaacatctgcataagaccatcactgctgtggtgatatttaaagaccaattattggcagcctgcagcctccagcctctacaatgaccctcagtgactccctcctcctgtcattcatggccttcagtaaccctatcacttagagagtgggctggacctagtgactcgcttctagcagagtacagcaaaagcgatgtgataatatttctgagattctgttacactaagtctaccattttacttgcctctctccttctctcttccccttccctttccccttttcctctgctcttccctcccttttcttccctctcccctaaaccctctctttttctatctcccaatcatctctctctttctccttcttctcactttcccctgatctcttttttcctctatttctctcctcctgtcccccttcctcctccctcttctctccctttttatctttctgtttcgcttcctccctccctccctccttccctcctcctctctcccgttctcctttctctgtttcctctctctgccatgtcatgagtggtttcataaagaaacacatatttaagccaacaactaacaaggttctaaagccttccaatagccacatgaattatttttttttttttttgagacagagcctcgctctgtcgcccaggctggagtgcagtggcatgatctcggctcactgcaagctcttccccccgggttcacaccattctcctgcctcagcctcccaagtagctgggactacaggcacctgctaccacacccggctaattttttgtattttttgtagagactgggtttcaccatgttagccaggatggtctgcatctcctgacctcatgatccacctgctttggccttccgaagtgctgggattacaggtgtgagccaccccgcccggccatgaatgatctttgaagtgagtcttctgaagacagccaggagctctgcgagcttgggagcagatcctatcctagtcaggccctgagacaactgtagccccagtagacaccctgcttgcagccttctgagtgactccagccagaaccagctatcaagctgcactaaagctcctaaggcattcttgtgagataataaatgtttcttaaggcactttattttgtaacataggtcatagacaactaagacatcaaacatactccatagatagctaataatgtagcttaatattaccagactttttttgtgtcttaaaaaagtcttagcttgaagttaatataataaaaaggtacaagcggatgcaccagagaaaaaaacaaaacaaataaacaaaaaaagaaacagaaaaacttgacacttcctttaacatcagtttcagaatcaccattgaaggtgaagcttagaaagtaggcaaaagcctggagaagatgtggctgaatctgtttcagataaacataaaaggatacgggttactgttattgaaggacactgtcaaaggaggcattttaatgcacttcaagtgtgtccaaacatttggttaacccagtgttttattttacagtggtaaataaacatgcgcaacttctggccattttatacatttcctctgtatattctatgatcctgatatcaaggaagacattaacttgcaaattactcgaaaggaagataaccggtaaggaaatggtcagtaagatatggatggatgtttgcacacatggaactcaatacaaaacagacacggccatggggcagacactgggtcttcacacacacagcaaggattgttaattcaaatgttccagcacgtgaagcatcacttaataataaagctcgtcctaaaatctacttctttatttcatcaatggggtggtaaaaaagtaggaaaaatggaaaaaactcgcctttgtgggcatgtacacaataaaatgagaagtgaatttgaaagcatgctctgcttcaaagatataccttggcctattcaatggggcacattgatggtctcagtgaaattgccatcattcttcattgaggaagaacacatataagcaataacaaagttctcttaaaattcttgcctaaagcctcatctagatcttaatcagtaaagcaatctgcttaaagccacatataacaaagaacacacaggtttaatgtagcaattttcccgaagtattaactttttttaaaaaaagaattgatctctaatcgtatcattcctatagagctcttcacagcttgcaggcatttatggactcttcaaattgccccatgaacttcctctcctacctttgattcccctaaaggaaaggaaatgtaactttgattgtatgttcctagttggaaacccaacaaggtttcccaacagctagtgtgtactcaagattgaccctgaactatcgatgttctgcccagaaggctgatgtgagcacatttaggggttttaaggtcaattcaaaagctaaagtaaccagttcctttacagacaagaagcataaactgggcctctctaagaaatgaggtgtgtcattatgaaaactgcagggcttaatgcttacaggacccctctgaaaggactaaattgtacccacacctaaatggcaaacgcctgggtccctccaagtccatttccaactaaggtccaagtactgcttttactaaaagtcctttgtattaagctatcccactctaaaaaaaatatcttcatgggttgcaccagtggcctcaaacttggctgcacattagaatcatgcagagaagttttggagttcctaatgcttaggtctcaacccttaccaatgaaatcagaatctatgcgggaagttaaaattgtcaaaaattccctagttgtctccaatatgcagccaagttggagaaacattgggaggcatcatttattcattcatccaaagatttcctgaacactcattatatgcttggcctctaggtgattccccaaccgcccgggtctttgggtggtcatgtcttatgcatctctgtgtgtctaactctagcatcagaggcaacaatgaatgcatacatgaatgaatgaatgaatgaatgaatgaacgaacaaataaatggcccttcttatctgcctctccctgacttgggatacaggaaggatttctaatgcttacagatagctctgcatagattaacccaacaaacaactaacaacgatgtagtaataatgcctgaaaaacttggcaatgaagaggagagacgatggagaagaaatctagtctcatgatgttttctttgcaaacaacctaaaaaggagtaaaaagcacagtctcaagggaccagtgcattacctcttactctatactcccacggaatccttaggcattgagacacctcacatatttacactgatcacatctgaacaatgccacctcacatatttacactgatcacatctgaaatatacatggtcacatacaccaaatcacatctcaagtatatgtgatcattttgcacctgctgaaatagtttcttccttcaaggccctgttaatattgcatctgcttgagaaagccttctaggagaccagcagcctccctgacatgttccaaagtgcagtacatgagattaaataaggtgcacactcatggatatttacttataaattattttaatagtcaaaaatgtacattaacttgtaaaagaagacagacttccttctatcatagtaatatgcactctcatttgaaaaatcaaggaaagcatgtgtcatttttaaaaagcaataatatgaaacacataagagaacagatgggaaaaactcatgaaggggacacaggaaagactttagtgtgggaaactcagctagaagcctttgtagtctacatagtcctgttaccctctgcattgtgtcagtatcatgtctgtgtctttttcccctacaagagagtcatcacagggcagggattatggccaatcatgcttgcactcctcactacgccaagtacagtgccttacaaaggaattctgaatcgacaaaatttttctgtgattgtgttaccagtcccatttaggttaaaagcaattgacaaaaaaagtaagcccacaaactaatttgggtcattgctaaaaatataaaattgatattattctcagaagcagccctaaatagatgacgtgtcatgtgccgctttcctacctacccatctttccaggtcttgatccttctccctgacaacagcagtgagaccctgacccctgatttcttctctaccagcttggccactgggcagtgaatccaggaaagcacttaagtcacaagagatttgaaagatttcttgacatagcactcgaccatctctaacctagcgtttggggatttttcagaaaattatctctgacaaaacgaaacacaaacctcatttcgatgtgaccaccagcttgagaagcccacggaagtcaccttgcccttctcgcctgagctctgtgtgatgcagctcctggggtctctccacagcaggcagtcctctcctgtccctcccactgagcctcagcccccatcaagaagcctggaggctggcaggcccccctcacacaagctgtgtggtataaaaggatctgacatggcttaggaaacagacgcagagcgcctcgactacaccgcggatattttctcagtttaaaaaaatgtgttctcacttaagaatgctaatggcccatgcacagaaataaaatccctgacctactttgaagctgaacttattaaacaagccgaccttattactcagaagagactgtaaaacagtagaataaagcccaaatagaattcctcgcatccctcgttaacaggagcagccaagaaaagcacaaaaggatgtcagagccctgggctgggagtcagaaaccagggcctggtccagctttttgatgactttctgtgtggcctgggataagtcaccatccctctctggctctcagaaccctcatctaggggctggacaaggaggtctctgaggccatttccacctactataactggagatcttattttttaggagcgtaatgttaaagtaaaataaaaatcaattatcaagggcatattatcagacacactaagacaggtgagggagtaagatggacattctgcctcctaggagcctatagccaggcagagccagtgggggcggtccacactgattaatggatttatttcccaacagcaatttgaaagccgccacaaggctacatacagcagacataacacaacttgtgtctgcaacaagaattccctctggctctccacctgacaactcagtttagtcgaatgaatctttcggtgtattttaaaccaccgcagagtcatgagtggccatccgtaagttataatcaaatttatcacactgggaaggaagagagtggggatacatttccacgggattttagggcagtaatgtgagtcattcctgctcattctggagaaaatcctggaactgcaaggtaagttatccaaaccagaatcagagaaaggcagggaaggtcactgatgtaacagtaggcattagtaacccacacaacagtagattagtcagtaatgataggtgctaccgtgggatgcttaaatgatgttactgagaaaatgtcatggtgcaatgtaattagagggcccccttttcaaatttcaggctcagagactcttctcttcattgactctttagcatatgctcaacctcacagagctcagaaaagaaagccagcggagagaagaaattccccaaaaagggacaagtggacctggggtttacattgagaattgcaaatcccatagtctctcccaggcatggccagggtgaactcaggacttgaaatggtgtgcacaaattccaaggcagagcaagatgtgggcaatcctatagagactggatgtccgcaattggagaatgtggtgtcccagggaaagatttagaagggtcccaccaagaagacacttggatcacgagctctgctgtcatcgttttcatagtcctcacactaagtagcctgctacagtgctccataccttggaggtatttgagtccccaaaggtactgtggaacagctagatctagagttcttgtttctgcccattttacagatacgagcactgagattcagagagatatacgcaaggccatagaggtatcaagtggcaaaacaggtaagagtgtgtgcagccccgcgtcaccgaggttaacccttaccctaacccgactctaatcccagcccctccctctctgtttacccacttcccacttgtcacacttgcttaacctcaaatttcccacagctgctaatcacagtctgcacccaccaatcacatcctgttccaccctcatgagtatcctcccacctcctgtgggagtgttgctgaactttgaacagagtgttctttgtcctccactattggtgcttgtatcatgatgggcctattctgacagctattctttgagctgtttggggtgtctccatgttgttgggcccagaaggtattctcttcatcttctcaatgtgcaatgctcattaacatctccagggatcaacacggataataaagaggaagcagagagcccaaggttgcaaggaaggcaaaccacaaccttgctgcagaggctttaaaaggctggggtgaaaagtcatttgaatgtttccagtcctgaatgcattctctgtactgcatctgacaaagctcccttgacacactgaacccccatggatccttttccccctagcaaagggagcaaaactcttaacaatctacttcagtgcatctccataaacagtggccgtccagcacccctgggagggctgccctgtgtcctgtaatgaatgcaggcccatggaaagtattgtaaagatccacagccctacagaactttgagaacactgttctatcaccattaacctacagtgggaaacagaggccaagaggtagcaaggtggtgtttatcaagttcccttagaaagtcagtggcagagctagaaccagatcttcttgattcaaaggctctacctaacacagtttatacttccctgagcatccctgaggagaacatctcttagttttgtttttgcctctcaaattcaattcacaattcttctggttaagcaccttcgcaaatttctcttaaagacccctatcccatagccagcccatatggtttgggatttatcctgccagcagcagggtatgatcagagtaggttcagattagcttaagtcaatcagcatatctactttcccactcccatagtttagggatggacacacgacccaattctgcccaactgcaatcataaatagtttattcatccataagggagaatgctgggattagtactgctgcagacttcatctgaccatgtggggccagagaataagaatgtggagaaagggaaagagagacacagagagagagagagagacagagacagacacaccagaattctatggaagtgctgtttgaacctttaattagctcacactggaagccagtaaaacctattcattgactatttccataaaaaaaattcctctgttgagtaacaaaaacaaagatagtagaaaagaaaggaggaaagaaaagaaaaaagagacagaaaaggaaataagagaaaagtaaagaaagagcattgttaccaggagtggggtgaatggaagttgaaccccaacctaaaagtggtcttggctatggtaggcagagctatgtgcagtgggcccagcaacatagagttctcatgatccaactgatgctcctctttctgctccttttactgcaacccaggttttatttattaaacctcagctcttggaagacgaagcttagagaccatctagcctcactccttccatttactacacagaaaagcttatctcaaagagggaaggaacttatccaaggccatacaagaatccaaggaacagtcacttatagaaacatcacgtgtgccttagagagctttgtaaaaccagatgccacctctacttgcccctgcacacgagctctctgcggcttcctactgtgctctaagaaatagaaaagcagctcctgtcatccggggtttggtcctatcagctaaaacttgatgttgttggaagctggcccaactttctcacccaggccattttgttcccctattggacctaaacaatcttacacaacaccaagatcaggtcaggtcattctgtagccacagtgaagtgataaggaacaagatgacttcatatttttttttctaagcaagacaaaaccaaggtcactgtgcaaatcgcaaaataccatgtatctttcttgtccagctcaaatgagtggctgccgcaactctaccaattatagctttaatcttgctctactattatccccttctagattaggtttcctcagatattcaatcatagaattgtccccacttcctaacagctcaatctagaaaaaactccacccccttgatgtctcccaaaatcatccatccaaagcccaaatcccttaacactgtcttgccgagacaccccatggttctctgtggtgtacattctccctcactacaataagtcataaacccaacttgttcaactatgggtgtgttcctaatggtctttagctggaaggcgttgatatccaaaaaaaaaaaaaaagttccacttcctttcctgatacagaattctttccataatcaagctttcctattgagtccacctccatgtcatgcatgccatcttgtgccatggcaaactaaataccattctgggcctttctaccttccacattcagatcctgttaactggaaaacccctcttctctgatcctctgacagaactaatttgggaagccttctctgaccccaggtagacaaaacaaaccctcatgcctctctgctacttccctatgctgcacacacactgttatgcacccatcacaccgaactgtaattatgcataaccccagactgcaaagctctctgaaggaaagggtcatgtaggggctgatacagaatagaggctccaggtattggctgtttactttcttcctacactgaaatgaatacctttcctattcgattgttgtcatacttcaaatcatattccaaataagcatcaaaaataataacatgcggccgggcgtggtggctcatacctgtaatcccagcactttgggagattgaggcaggcagatcacctgaggtcggaagttcgagaccagcctgaccaacatggagaaaccccatctctactaaaaatacaaaatcagctgggcatggtggtgcatgcctgtaatcccagctactcaggaggctgaggcaggagaatcactttaacccgggaggcagaggttgccctgagccaagattgcactactgcaccccagcatgggcaaaaagagtgaaattgtatctcgaaataataataataataattgttacacacgtccatataaaaggctacttgagcaggcttagagtgagcaacaaggctgtttattcacttgggtgcaagtgggctgagtccgagaaaggagtcagcgaagggtggtgggattatcgttggttcttataggtttgggataggtggtggagttaggagcaatttttgcaggcagcattcacaagggcggggtggggggaggtgcgggggtgtattgtcactagggtggggaggaatgttacaaagtacattcacaaggaaagggaatatcacaaagtacattatcacaaggacagggaatgtcacgatggcttgaccatggtgtggctagctcagaggaccttacaataataataatgataatgtgcaaatcaagactcctgtgaaagtgcagctttggtctgttgtaatcatgtcacttgtcacctgcacaatgctctcagacttgcaaagcacttcctcattaccttgtctcatttaatgcagtcctcatggcaaccttggcttctattgtggcttctcatttctgttatgtctactcttccaagatgcttagacacatgggggactcaaggctgggatgaaatcagggaataactgtagttgtctgtcacataataataagcatttagtacatgttagctattgatatgattatgttatgaacattactcttactattatggactaggatggtcctaggcctgttcaccattagatagattccttgcccttgatctgttctgctctgtataatggggagaggttggagtggagattagggggtggggaacaggtttcccaagctcctcagctggcttctgatttgatcagctagatgcactcttaggagattaggaggagggagactccaggtcatgtatgtctgtctgtctgtgtctgtctgtctctctttgtctctctttatctctctctctctctctgtttgtgtgtgtgtgtgtgtgtgtgtgtgtgtgtgtgtgtgtatgtgtgtgtgtgtctatctgtctctctccccactaaccctctcttctttaggcagatgttcttgtagcatctcaggccaatgctggacttcccaccatagcttctgtttgttgttaatctctgaattggctcatctttgcaaccaattccctacattaaattccttctgtttgaaacatctggagtttgtatttttttttgctgggccttgattagtggatgtactaggtacgtacatttgagcaagttacttgctgcattaaagtatttttatcctgtgaaaagttgctaatatctcaacattttgtattgagcatagaaagtaaaacatatgggcacataggcatctcagcacctggcacatagcagtcattttaaaaatttagtttcttctttcttcattagaaagaattgttatgtgcaaagatctcattctagggactccctagataaagaaataactgaaactattacagaatcaacaatgattattacaaaattatgtgccatacagaatcttgaaatacctaaaaatacaattacagcatattgtcatataattgtgtccacccaaaagaatatgttgaagtcctaaccctcagtacctcagaatgttaccttatttggaaatagggttgttgcagatgtaatctgttcaagatgaaacactatactggaatagggttggccttaatccaatttggctggtgtctttataggagaagatgcacagacagggaaacagggagaatgcagtgtgaagacagaggactggagtaatgaatctacaagacgaggatgccaaagattgccaggcaacctccaaaagccaggaagaggcaaggaagaattacccttcagattccaaaaggagtctggccctgctaacaccttgctgtcagactcttagcctccagaactgtgagtgaataaatttctgtgtgttgtttttttgtttgttgttttttttgccacacacagtttgtggtgctttgttgtagcagccctaggaaattaatagaatggtaagaaaagataatgagttggtagaattctgttggctcttaacattttcatcctgttatacgggccctgtataatccttgggagcatgcatatgccgagatagcattcccatgagtaggttatgttacatggcacccttgactctaagaaagggagattattctgagtagatctgacatagtaaggtgaactcttaaaaaagatggaaattccttctggcgaaagagatgtgtggtgtcagaacatttttatttgagagacaggctccatttttggctttgaagatgaaggaagcacatgacaaagaatgtgtgtggcctctaggagctgagagtggccaccggctaatagccagcaaagaaatggggccttcagtcccaccatcacaaggatcagaattcaaccagcaacaaggatgagcctagagctaggcatggtgatgtatgcctttagtctcagctactgggggaggctgaggcaagaggatcagctgagctcaggagtttcagaccagcctgagcaacacagcaataccccatctcgaaaatcaaaacacaatgagcttgaagcagatttttatccagtgtctccagatgaaaattcagctcagctaacaccttgactccagctttgtgttatattgaagagattccaaccatgctatgcccaggtttctaacctacagaactctgagatcataaattattttaagctgccaagtttgtggtaatttcttatgcaaaaatagaaaaccaatacaggtaggtacattcactccttaaaattgtatgcaattattaaattataaaaatgctaaaggtcataaagaaatatgcaaaatatgtgtaatatagcattaactttaaaataactgaaataaaatggtactctcttctgatggtatctatgccaaatacatatttatgtggataaaacaaaaaatcaaagagactttggatgtactagggtgacaggattattagttcaaagttgtcattagtcttcttttatcattttaagaatataaaatattataaaattcaagatttttcttgcccccagcccacattgaacagacaggatagactctaataggaagcatggtgtcctatgagccaagctacttgaaaaagagaaccacatgagaactgacatcctataaaattccactggagagagagatttctcagttagattaatatatcaccacatcacaatgactcatttctctagaaattccacacaggccctccttgtggccattctcctccctgcccaagagaaagaaacatagacaccgtatacttggggctaaaattgcagcttgtgttaagggcccaagatagcaggcatgctctacacgttccactttgcatttcccgtaggtctctgtcttggtctttctctttccatagctacctcctaagtggcttgaacaagttgcttaacattctgtggcctcagtgccctatcataataaagacattatgaatgtattacttaataaattgtacttccctctttttccatatatttgctgtgtgatcttagggaatacagtctctagcagtttcagttttacaacacctgaaatgggtgatgactacccatgcctacctccataggaatgttgctagcattggcattaacgagcagaattacactgttaaaggtcaagccagagagaggacaccaaatcccatccatagcagagagaatgggcagcaagtgctgcaaatggaggctgccaggtggaggtgtacagagaggtttctgcctcagagaactgaaaatccaaatactacatggtgtaatgtaaactcagaggcatgccaagcttgtagcttgctttggttattaaaatgtgagtacaaaggacctaaggtccttcgggacagaaagggccagtgctcagttccccacatcctcttttcctctttgtcatagtcaccagcaaagttacagatggcggctgctctatcatcttgcagtgtgttacggatgtttgtcccctccacagaatctcatgttgaaatgtaatctccagtgttggaggtgggacctggtggaaggtgtttcggtcataggggtggatccatcacgaatggcttgatggcctccttgcagtaataagttcacatagatctggttatttaaaagagcctaggacttttcttctctctcccttgctccctttcttgccatgtgacaagcaggctcccttttgccttccaccattattggaagcttcctggggcccttgctagaaatagatgctaccagtatgctttgtgtacagcctgtagaaccattagccaaatagaccttttttctttataaattacccaacctcagatattcctttatagcaatgtaaaatggactaacacagaaaattggtaccaggaatggagtgttgctataaaagtacctgaagatgttgaactggtttttgaactggtaatgggcagaggctggaagagtttggagatttcagaaaaagagagggagatgagggaaagtttggaacgtcttagagacttgttaagtggttgtgaccaaaatgctgatagaaatacggacagtgaaggccaggctgatgaggtcttagatggaaatgaaggatttattagggactagaataaaggtcactcatgttacaccctagcaaaaaacttggctgcattatgctcatgccctaagaatctgtggaaggttgaacttaagagtgatgacttagggtaactggcagaataaatttctaagcagcaaagtgttcaagatatggcctggctgcttctaatagcctatgatcagatgtgggaacaaaggagtgaccaagttcagaacttataattaaaagaaaagcagaaagtataacattggaaaatctgcagcctggccatatgggagagaaagaaagaactttttcagaagaggaattcaagtgggctatagagaaaccatttgctagagagattagcatgactaaaagggagacaagggctaatagccaagacaatgggggaaaggccttaaatccatttcagagatcctcagtacagcccctcccatcacaggcccagaggcataggaggaaagaatggttttaggggccaggcatgggacccttctgccctgcccagcctcaggacactgctccctatatcctggctgctccagctcccactgtggctcaaagggccccagatacagctcaggttgccagcccagagggcacaatccataagccttggaagcttccacatggtgttatgtttgcaagtgcacagaatgcaggctttctgatacatcctctgaaatctaggtggaagctggtaagcatccttcactcttgcactctggcctgccacaagggcagagccctgcaaagagactctactagagcagtgccatggagaaatgtggggctggagcccccacaaagattccccaccagggtactgcacagtggaattgtgggaatgagggccactgccctccagatcccagaatggtagagccaccagcagcttgtactctgagcctgaaaaaacagaaggtactcaactccaacccatgagagcagccacatgggctgtgtccaagaaagccacagggacaggaatgcccaaggccttgggagcccaccccttgcaccaatgtgccttagatatgggacatagagtcaaaggaggttgttttagagctttaagatttaatgcctgccctgctgggttccagacttgcatggggcctgttgcccttttcttcgggccaatttctcccttctggaatggcagtgtttacctaatcctgtactactattgcatctttgaaataaataacttgtttttggtattgtaggctcatggatggaaggaacttgttttgagtctcagataagactatgaacttttgacttctgagtggatgctctaataagttaagactttggggaactactgggaagaaatgaatgtgttttgcatgtgagaaggacatgatatttggggtccaggggtggaatgatatagtttgaatgtttgccccctctacaaatctcttgttgaaaagtaatccccagtgtgggaggtgggacctggtgggaggtgtttgggtcatggggggcagatccctcatgaatgtcttaaggctctccctgtggtaatccattcacatgagatctggttgtttaaaagagcccagcacctccacctctctcttgctccatctcttgccatgtgacataatggtttccctttgccttccaccatgattggaagcctcctgaggccctcaccagaagcaaatgctggcactatgcttcatatacagcttacacaaccatgcagagccaaataaacctcttttctttataaatttttcattctcaggtatttctttatagtgattcaaaatgaactagcacatcttggatcccatgtatagagtagagccctatccaaatgccaaggaatatgaacaaattgaacttttttttttctagcctcggacttatggggctgtttgttactgcagcattacctcctgcatcctatctagtatagctttaagctactctccccctctaacaagtggagaaaatgaggctgacagatgaaatcattggctcaaaagcacatggctaccactgatagaaccaagactcaagttcaggtggcctgactccacagcccatgactctcattcactgtggaaacttccctctgccccttgatgcctggataacccaacattgtgttcaagtggaagcagggatgtcacaagaatcccactttaaaatgagcagtatactgtgccattcattacctggactaatgagacaaaggtgatgcaggagatgccaagcatgagggcattctgacagcaagaggtatctcattaggaaaataatcctgaatgacattgttcttctctcaacaggctcccgaagaggtccaggtgccaagatagtccctttccccaagtcccacaggatctaattgtgggttctgccctgcctggatgtcagcttagattttctcaggccacaactggcttggcagtgggtatgttagccctgattttaagagaagcaaacattatgtagcagcccaaaaaagaagcccctactgagaactttgggtactaagagacaggttctatgtactcctcccagttgatgatactcagtgagatgacatgtttgccagggacagtacacatctgtgcaccctgaggttatgcaagatcactcaggctaaacagttaggatacccagattcacgaccacctcaaaaacagactatcagcgtgaccttggttctatctctgagccctggactccctattcatagcacaagagaaatggaaaagtgatatgtaaggtgatttccagcttaaaatataataataaaaactgatgtcaactctcacacatagctgataggcctataaattggtacatcccctatggagaataatttggccatatctatcaaagttaaaaatgtttagcaatctcagacctaggaattatgctaaagatatgcttgcacagtgaaataatgtttgctcaaagtaattcattgcaatattgtttgtaacaggaaaaaactgaaagcaatccaaatgcccacctatagaacccaagtaaataaatgatggtgcgtgcatacaatggaatatcccagagctatgagaaaggaggaagctctttatgtctgaatgcagaaatacatccaagatacattaagtggaaaaaaataaagccaaaagagtttttgaaatacgctacaatttatgtaagaaaaagaagataatatgatggggatttaattttgattaatctacacatgaaatacctttggaaagatatacatacacatacacacgtacacgcacacatacacacacacacacacacacacacacagagtaacattggtaatctccagggaagagaaatgtgtggctaggataaggaataaaaagagtaattttcagtgtacctttttctttcttttgattttttgaaccacataaatatattaccacaaaaaaatgagtaacattgcaatatttttaactgctgccagccaggggttgaataagaatcaagaaaattcccaaaagcacattctgaagatgctgacgaatctcaagtatcttcctcctggagcccactacccaaaggtttctcatgggcaaaatttttctcttctctattcccagtatacattgtattatctgccttcctatcatccattgctcttcagaaatttcaccatataccttaaatgaaactgtaagacttttaacattttcttttcaattttgaaaaaaatgaacttagggataagtgaaggaagacatgtgatacagtttggatgtgtgtccctgccagactgcactaaaatgtaaccccgattgttggaggtgggatgtagtgggaggtgactggatcatgggagcggatttctcacaaatagtttagcaccatccctcttggtactgtccttactatagtgagtgagttctcttaaaagctggtcatttaaaagtgcatagcacctccccctctctcttcctccagttcgggccatgtgacatgcctgcttcccctttgccttctgccatgactataagtttcctgagacctccccagaagcctagcaggtgatagcattacgtttcctgtataacctgcagaaccatgagccaattaaatctctttctttataaattatccagtctcaggtatttctttatagcaacgcaagaatggactaagacaacacggaaagaagtaagcagaaccaagctctaggtagggctctcatttcccatgcagctgttgggtgagcaccttgccctctcagagcctcagtttccccactggttcaaaaagagctatgggatagctgaggtctcaggtctacttccttccagctttatgtttctggggttctaagaatcatgtggaatagagaaaaggcaagaccacattttggaggaaactttggaccagctgcctgatgagcattttctcactttactgtcatctggcaacatcctaaatgaaccaatgagtgtccagatgggggccaaactatgagtcaaatcaacacacactcacttattatttatgtacaaattctgtgacaggtgcagtattagaagccagaaatacaactataaacaggatacaattctgcctggacagagatcatagtataaagtacactatgtagcagacaaaaaggtgatttcagtctccagcatctcatgacaaacacgtccacatctggccacaactgactaactggcacttaacttggtatcctgccaaaacaatcaaaacactacaaaaatatatgagtgattttttccagcacagtattttgatcattgatagcgaagaaatacagaagtgagactcatgtttgtcttggctttctgcctggtggttattttctagacccgacacagagaggtggaggccaaacagcatcgcagtcttgttgaactgaggaacccgaattagagttctgggctgctgactcatctggaatttgtgaggaagggtaccagagagttcatatggggagtacctgttagaatttggatattggctggcctgcatatttgcaaggtaaaactctgtaaggtctagaaaagagtggttgatgcagggctgagagctgaacagaaatgtgagaggttgaccagtgctgggaacctctggaatcctggcccacctgcagtggagttgcagttgaggcttcagaaagagcaggttatagtagtgaatattacatcaaaatcaaagtaaggcacacacatgaagataactgataagccaaaatagatccctcctaacaaagtataagacaataatgacagtttcagaaggacacgccggtaatttaactgcttaccaggataaaattcaataccatttaagtccaatcaatataatccagaccacctacagcaaactatctaccattcttaggtaacaaacaggacataaataagtaattagataggcaaacaaataaggagtaaaatgaacagatcccaagataattcagatgttagaatttgcagatgagaactttaaaatagatactataaatatttttgaaagatttaaagaaaattggatataatgggaggatagctaggaaatcacagcagagacatcagaagtaagaaaataaaaataaaaatctgatgactaaaaactaccatatctaaaataaaaagcttactctggggttagtagcagtgcaggcactgcagaagaaagagtccttgaatataaaagcagatcaacagaactaatccagtctgaacaatggatacatatacacaaatattaaaaaataaagagactttgcaacccgtgacagtgcagaaaaatatctttaacacatttctgagaattttaaaaaaacataaggaaccaagagagataccatattcatggattggaaggttccaattaagtggtagattctcccaaaattgctctacagacttagcgtaaattttgatcaaaatcccaaaagtattttttctttttaaataaatcaacatattggtgctaaagcttgtatggaagtataaagaaccaaaaatagttaaaacaatcttgattaaaagagtccatgtgcaaatccagagatatatgggaactttatactttttactcacatttgctgtgaacctaacactgctctaaaaaataaaatacattgtttaaaaagtacttgtgcagtgggacttgctctattgcacttctgttgtaagaatcttccactcttggtggctgctcccacggttctgggtctcagaatgaaaaaagagcatagatctgagctggccagacccacagcttgaatagagatgctctgctaaatagctcggatcagctgactcctaactaaaccacagacatgtgagcaaaaaaataattgctatttaaaaaaaaattgcagagggtatatacccagtaatgggatggctgggtcaaatggtatttctagttctagatctctgaggaattgccatactgtcttccacatggttgaactagtttacagtcccaccaacagtataaaagtgttcctatttctccacatcctctccagcacctgttgtttcctgactttttaatgatcgccattccaactggtgtgagatggtatctcattgtggctttgattttcatttctctgatgaccagtgatgatgagcattttttcatgtgtcttttggttgcataaatgtcttcttttgagaagtgcctgttcatatccttcacccactttttgatggggttgtttgtttttttcttgtaaatttgtttgagttcgttgtagattctggatattagccctttgtcagatgagtacattgcaaaaattttctcccattcccaaaggattataaatcatgctgctataaagacacacgcacatgtatgtttattgtggcactactcacaatagcaaagacttggaaccaacccaaatgtccaacaatgatggactggattaagaaaatgtagcacatatacaccatggaatactatgcagccataaaaaatgatgagttcatgtcctttgtagggacatggatgaagcaggaaaccatcattctcagcaaactatcataaggacaaaaaaccaaacaccgcatgttctcactcataggtgggaattgaacaataagaacacatggacacaggaaggggaacatcacacaccagggcctgttgtggggtggggggaggcgggagggatagcattaggagatatacctaatgttaaatgatgagttaatgggtacagcacaccaacatggcacatgtatacatatgtaactaacctgcacgttgtgcacatgtaccctaaaacttaaagtataataataataataataataataataataataaaagcagaggtgtaggtcttacatggatttcaagacttgtcataaagctataacaattaagacaacaagacatcaaaataatgataaaaaatagatctacagaaaaaaaagaacaacagcagaagatccaaaataaacccttacatatgcagacacctgatatattataaaggttcaactgaaatcagctggggaaagatgatatttttaacaagagtcctgggtcaactgatatccatacagacagaatcaaagtgacagtttttatagtatctatataacactttatgtgaaaatcaattttagatggattacatagacctatatttgaaatgtagagtaatagaaattctaaagataatgtgagacaggattttttttttattgtggggaacacaagtatttcttaaatatggcaaaaataaataaaagactgataatgggacatctttaaaatcaaaactgttattcatcaacagatgccattaattaagtgaaaaggcaagctacagaaagaaaaaggatatttatgatatgtatacaaggactcagatctagtaaatataaagaactacaaatcaataagacacaactcaatataaaaaaacaaaagacctgaatatccaattcaaacacatgacatcaagatcacctgtgtgtgtgtgtgtgtgtgcatgcgcgtgcacacgcgcatatgtaaaggttgctcaatttcactagtcatcagaaaaataccacaatgagctatcaccacatacctaccagaatggctaatattaaaacacagacaacaccaatatgcaatctgtcatattagaaagctatttggcagtatctgcttaagccaaagaacaactctactcctagttacatatccaagagaaatggagtccaatactaccaaaaacacgtacagaatatttacagtcacgtggttcattatgtctaaataatagaaacaactcagatgtctgtaagcagtagaatggatacattttggtatattcattccatgacatactatttaagagtaacaacgtgggccaggcacggtggctcacgcctgtaatcccagcactttgggaggccgaggcgggtggatcacgaggtcaggggatcaagaccatactggctaacacggtgaaaccccatctccactaaaaatacaaaaaatcagccgggcttggtggcgggcgccagtagttccagctactcgggaggctgaggcaggggaatggcgtgaacccagggggcggagcttgcagtgggccgagattgcgccactgcactccagcctgggagacagagcaagactctgccttaaaaaaaataaattaaaaataaattaaaaagtgaatacaacatggatgagactcaaatataatttcaagtggaagaaactagccaaaaaatatataatttatgctcttatttatataaaattcaaaaacagggaaaataattctagtagtcacaatacctttgcaaaggagaatcaatgacttggagtgagaccgaggagggcttctgaggtgctggttatattctgtatctcgatcaggatgttgtttacattattatattcagttataatgtgtcttttcctgcatttttattattcttcaaaataaaggtttatccacacacacaccaaaaaataaggaactgcaagagtccagttgagagctgacgagagccaatgcagtgatactagtgatggtaggaaagatacatagtcaagaaatattcaggagctaagttggtgggtctgttttaattgaacatatgcagggatggagtagggcgaggactgaggaaaaggcaggaatctgaaatgaatcttaggtttctttttagcttcgctgaagaaatgaatggttgagccaatgatggagatgaaaacttcgagaagaacatgttgagttgaagtgcctgtggcaatccacaggaataactccaacagctagttaatcgtaagttcagcagaactgtccgcgcaagagatatgggtgtgggagtcatcagcctccctggtcataattaaaataatgagattggatagactcactcacaaagagaaatatgaaggggtatggtagccagcactctggggaacattatatttaagggaaaggcccagaaacagaaagctgtgaccaagacagaaaaggttcagctgtagaaattgttaagaaaccaagagatatagttatggaagcccagtcctgagggaaagtcctgaaaaactgtggccaataaagtgacttctctccaacagcttggcaggaaggcaagaagttagctctatagccgtggtccttgggcaagttatttctcccctctgagcctcatttttttcagctccaatgtgggaatgttacagctaaagagtattgttaaaggctattgtgagaagtaaataagacaatgcatatgaagtgtttagcaaatagtgaaaggtctatggtcatggtgacctatagaaactatgagcaaatcaagcagggtgttctttctcaggatgagagagatagggatatgtttagagaccaaacagaagagccagtgtataaacgtcactggatacccagagaagaagcagaaagggcagccccacgtccccaggtagatggaaacacctgccactctgacacagggtaagaacggatgtggagaaagacacatctgacaaagaagtggtagatgaagcaacgaaaggggtcattcctaccaaaggcctccgccatgaactcacatgcatttgggcaagacccctaggtgtgggacaatcggtgcagatactagagatattgtaagaaataacaagtttcatttaactcacttactcatcatttagccactcacctttgacacatactaaatgcctactgggtgatttacagggaaaaaagaaatccttcatacccttgaggagataacagttccactgggatgctgaacaaggaagaaaagtgcagtgaatatatattgaacattgcctttgtaccgaaccgtgggcttacatgcatgataaatgatatcatgtgtatcccttagcagaatgggaggtaaaaatcactattcccattttacatatgtgaatactgaggcatgaaaatttaactgattagcccaaggtcacatggttgtgtctgactggtagtgcaataagagaatgcatataagcaagtgattgcaaggaagtaaggtgagatgtgtgttgcagaggtgggaattatggaggggtcaatgaagaaactgacgtataagttagattccgaaataagagttaaagaaaaagggtcaaaggcaagaaaaaactgacgaatgttccattgtcaccagaatatatgtgtccacagctcactccttgtatagagagaagttgtctataagtcgtgcttgcctccccattatcaaaatgtggctccttcttgaataagtacaattcattatcatgactgaagttatactggattttctccaagctttcctgagtatgcagaattgtccttctgcactgtcaaatccccagatcacatacttagcagctgttttcaagatattttgtcagaattgcttgtcatagaggcatagaataatgtgtcgcaggcatttttgaatataactgtctctcactagagagttggggtccagtaaccttgatgagcttaggaagctcgagagacctcctggcatgcagccctgtgcttaccctgtctgcctgcacactgtcccagatgctctgagctcacagcctgtcaatgtgaaaagacaaacacacaactgacaaagtgtaacaagtgtcaaacaagaggaatgtgggacagaacgaagtgttagctctacacagacagcactcctccaaggaggtcagaccacggttcaagcagcatgaacaaaaagcagggagtttgcatgttcaagggtaacttcatgaacaaaagttacttgggcctgaaagaaggcaaacccagggacaggatgcctggaaatgaggagatgaagggtacttgaagtcagactcaaaagttaaaatgtatcttaaaggcagcagggagcccctgaaagacaaggaacaaggggatgtcaagggaagtgcatgatggtgaactggagatgagatggatccacaggaggcagggttgtggaggcctcatgtgatgggaggatgtgggtgtcactcaggtcttggcggtgtgggtggatggaagcgtggtgggtgggcagcgaatatgtgtaatgctgttgtaatcaggcgaccaatcagacaagggctggggagggagcagtcgggctggccctcaggcttctggttggacaagtggatacacagccatgctgagaaacggacacaaacaaagaagcaggttaggggaagagggtcagtcagtgcagtttggggtgtgaatggactgtgggacctgcaggctctgcagcatcctggggctgacatcagagcagcaagtttcccttgtcattcctatcatgagccagtttcatagtcaggtttctggccttttccaaggaaatccctgctgccatgtgcatccatgcacgcacacacaggtgcatccctcacctccatctcctaattgcacagacacctccctccacttatcaacaggccaacccatttcagaccatcagtaaaatgccatttagtgataacctcccagtgatgtctgatcctttggtggctgctgccacatcccccagggactcatgaaattgtgtctgtcttgatactctgctggggccactttgtggaaggatgccaatgcccccatgttgccagaggtatctgcacctgttccctttcccttccttgcagcatctagcactgtgctcagctgcattgggaaatcctgcttgctggcctctttgcttcctcccaagtgtcctcccttcctctctgcacattcttctcaccatatcgggtctatgagtcacctgatgaacttgttaaaacacagattctgattcagtcggtggggtggggggtgtccagaattctgcatttcaaactccaaggtgatgccaatcctgctggtctccagcaagatttacccatgcccactgtctccactgcctcacacccacctccaatgcccacctccttaccagaacatctctggcttaattcactaatggcctctatgtgactaaatcccctggacattagcaactgaccctcctgctcctggaaatagtctcttctctgatctgacattggatggaagctccatgagacatctgcttctactgtaaatgggctggctagaaacttcccaaaagaaatgcctgtcgattccactttctgcaccctcgctgggagctgactccccgtctctgtcctttctgagagtctcagagtgctctgggtcactctgtctgctctctgtccaaaagtaggagaatgtcttcatctacagcagcagcatccagcagaaccctccacaatgccagagatattctatatccacactatcccacatggttgccactaggcacatgcagctcacgtggccaagaaactgaaatttttatttttacttaagcttaattaacttaaaaggccacgcatggccaacagctgacatacaggacagcacagatctatgtgcacaacaccccagaaatgagctcatcgcataccacatgttcctcaggactatggcaaactttaacaagtctgcagttatcctggaaggtggtaaacattagtggatggaaagcatgcctgccagactcagatgacttgagtacaaatcctgcttctgatactgaatgagtgactttaacaagtcacaacttcagttgtcttcattggtaataatatgaatataacctcagaatgtcttcctaggggtaagagtagtacttatctcattgactttctgggagtgttaaataagtaaatgtatatagagtgcttaggtcaatgcctaacatataaatgctcaatcagtgctgtcttgtcacgattttgattaagtctccaacctggttttgcaaagaagggattattgtcttaccatcttcattttgccaatattaaagaaaaaggggccacaccaagaacacacagaaaacgagggcttgaatatggtcctgcccagctcggaagcagctggcaggtcaaccaggggccggatgtcccattcgaagctgcagtgactgcctcccagggcggccttcccggtgagctgggctgtggggcagctcccacagagctcactatctccatatccccagaagtggctggtgggccagatgtagcaatgcgggcacctgccatgttcagtgcagttgtggcctgtggtctatcctcaggggcctgaaaaggacttgtagctccccttcccagatcctcagggcctgcataatacccctcttccactctaccctacagggacaggacacacctccctttctacccaatgtagccaactgtgtgtttctaaattcagaggagatcccagcaagatgccacgtgcttttgagatatcctcattgtcattccttgcagaaggtaccctaccccaggaagcagtcatggggagctagccacccaaggagcccacatgggatgggcagatcagaaggctgtgatttgaaagccaaaggcagaatccttgctctcctatctggacagggtaggcaactggactggagtgggattatcactgggcttggatccagaagactgggactcaaatccttgctttgatacttcctgtttgatcttagtgagttcatattacctctccgaggctgtctcaatgagtgaaaataagcttgtatgtagcaatgcatgacttttaaagtattttcacaagtgtgaattgaatcatttgttcattcagcaaatattcattgaacacccactgtgtgttctgtccctggagagacaatggtaggcaaagcaataaaatccttgccttcagaaagctcactttttaatctaatcagctaagtgtaatattaaccactgagatcaatcttatgaagaaatattacataacaatgaaaatgcatcaacaccagctgtgtggttgtttcaattattctgtttgctcccctaattcagtctctgtcctccctcatgcacctggaggcccaaatctattcactgcatctctcagccctcttaccctctggtggtcagtggggctcagccagtgagaggctacagcaggaggtagaaggtaaatttaaaacaaaaacaaagctcagggcatttctttcttgtttccctccaccatcccctaccccaaagttcttagttttcatacttagtttctaccactccctcccctgccccttgagacctgggaagtaacagctccctgctattgtttgtccctggctgcctcctcattcctcatttgtttcctcaattctgctcatatccctgtaaataatctcttcatgcctagacatggtaactcatgcttgtaatcccaacactttgggaggccaagacaggaggatcacttgaggccaggagctcaaggctgcagtgagctatcatcctgccattacgctccagcctagcatagcatcttccaatctcttcttctttctctctctctccattgccacctctcctcctttgactctgaccatccctgcctccctcttttataccccttgtgattacagtgggcccagataaatcagtataatttgcccacctcaaaatccttaactccatcataccagcaaaatcccttctgctatgtgagagaatacattcatagattcttgacagcaggatgtggacatcttttgtgtgtgtgtgtgtgtgtgtgtgtgtgtgtgtttgagactgagttttgctcttttcgcccaggctggagttcaatggaatgatctcggctcactgtagcctccacctccctggttcaagcaattctcctgcctcagcctcctgagtagcagggatcacaggcacacaccaccacgcccggctaattttgtatttttagtagagacggggtttcaccatgttggccaggctggtcttgaactcctaggtgacagagtgagactgtctcaaaaaaagaaagaaaaaaaaaccttcctcaataaactctaactagaaacaaacatgctgtaaaggaaagagcaggtgccttgagaatgtttaatgacaggctcatttcatctaggcagggagatttatcatctcaggtgggattggaagaatgtatatgaggtagacaaacacttgtacaatagtattaaaatcctccactttacaaatgagaaaagtgaggttcagagaagggaagggtggccaaggttatgcaaatccagtcttgtttgtgcatgcaaagcagctcactgtgacatttgccttccaagtcctagggacttttattactttcctattgctgcagtagcaaagttccacaaacttggtgatttaaaaagtcaagaaacaacagatgctggcgaggttgcgcagaaatagaaacacttttacactgttggtgggaatgtaaattagttcaaccattgtgggagacagtgttgcaattcctcaaagatttagaaccagaaataccatttgacccagcaatcccattactgggtatatacccaaattaatatacatcattctattacaaagatacatgcacgtgtgtgttcacaaactctgactctgaccatccctccctccctcttttatgccccttttgattacggtgggcccagataaattggtataatttgcccacctcaaaatccttaactccatcataccagcaaaatcccttctgctatgtgagagaatacattcatagattctggacagtagaatgtgggcatctttattattattattattattattattattattattattatagactgagttttgctgtttttgcccaggctggagtgtaatggcatgatcttggctcactgcaacctctgcgtcccaggttcaagcaatcctcgtgcctcagcctcctgagtagctgggatctcaggcacacatcagcacacttggctaattttgtatttttagtagagatggggtttcaccatgttggccagactggtcttaaactcctgacctcaggtgatctgcctgccttggcctcccaaagtgctgggattacaggtgtgagctaccacacccagcctggatgtgggcatctttaaggggtccattattctgctactacaggggcctacggccatggagtggatggtaacttgcccatcataaagactaggtcctattgctgaggtgttacctgcagcaatgttgcctacgggcagccacaaacaaaaccaggattctgaggccagatggcctttggcaaaaggggctggtccagcctactgtcagctttgtgaccctgagtgagacacataacctttgtaagcttcactttaccatttgcaaaatgggaacactatctggtccccatgctgagaagacacgagctggtgtgtcaagaactcaccacacagtagggcctcgggctcttccatctctcttgtcctcctcctgccttccattctctagatgcacacacacgtgcagctcacgttcagtccctcagcagatgctatcactatactttggagactgatgagctgttactaatgggatttttgtgtgtgagcagggagaggcagtgggagaatagaagagcttcagtacctcattcatcctgctgagattttgacacagacacagatcttaagagaattaggcaaagaagcagacatgctatgaataaatgtcagtgcccctcacaaaaggttacctcccaaggcctcactttttgcctgccaatactctgaggtaccagagtatctctgatcacgacgcccatctttttaacatcttttgaagactgccctgctgctgacaggacagagagaggcctccattgtggggaacctcagatggccttgtgcctgtctcctgactgctcttctcatttgggcctccatcccccccgttccaatgcaagcaaaaaaagagggtatgtcccaaatttgatatcctcttagatatctaatcctatgtaagacctgttacttgacatctttcggtgaagcttcttcagttgtaaaatgggtcactgtgaggccaaataagatcacagttggaacacaccaagaacactgccaagatacaatagctagcagagatttcattaacataacacttacagtgtgccaggtgttcgataaggtttggatgccctcctttatcacactgtctaataactgacatctttctcaggagactgtggaccatgggagggtacagaggtgtcacttatgtgtatgtgtgtgtgtccgtgagtgcctagagcattgcaggtatccagtgaatgcttgcaggaaagcaaatggaagaacaagtaagaaaaggacaactggtatgcccaccaatgttcaattcagtagaaagttttcttctggagactccagggactgttattttccctggtctactaggtgttcctgctaccatactgcagcctcaatgactgatcttactaatgacacatttgaccttgttacttttgtgtttaaaaccttttaatggtctccaggtacaagtccaacgttcttagcttggtcaaatcagaccctcctgatctggctctactggattgtatctctcttgctgcatctccaaccacccttcttcttgaattttgtgcatgagcagcaccaaacttggcaccatcctccaaataccactgtatctttcctcacattgtgcctccatccagaggctctcttccttctcaaaacccacaattatctctctagagctggctccagacgaccttccagggcaacttgcagcacccttgaaaagaattattgcccattatgtttgctctcacttcactaacagctgtaaatacctttaccatgcatcagtatttgggcagattctgtgccacacaactgtcataccttatctctaagccagtgcctctcaaatttttcccaggcattctaatgccccgaaggactttaaagacagattcctaaaccccaccctcagattctgcttcaataggtctggggtggggccggagaatttacatttctgataagtttctatcactgctgctgctgctccatgatcacactttgagtagcagtgcctcacttgtgagcaaaattacattatcatcttgcaaggggggagaggtaaggacttgccataggctaaatgatccagtggtgaggctagattttgaaacccagtctctgaagccacagcctggctcctttactcagcaacagcactaagagcatccaacattgactagcagttacctctagttcattccaccaagcacacatatacagtatctcatttaatcctcagaatcttctaaggtaaagccattgttcctacacgacagctgatgaggaaacaggggcagaaaaggtatcgcagccaaagtcacacggaactgagcgaagggacaatgaccacgggcccatgcgctaacaatgaccattttctaaatgtgacgttgctcacccttcattgcaattcttggtttacacaccaagtctttctggccaggccacgagcacctttgaagttaggggaaatcatctcatttaacttcacatcctagccactggcaaaatgcaagcaattagcaggtacctacatatgtttaatgaatgaatatgtaagactgaaagagtgaacaaagaacaggaaaataaccacattcttagccacttgacaagtagattgaccttctctctataaatgatgtgactcaactcacagaacaatccatagaggggcttcgaggaggtgagtttgtcttcaaattaaaaaaaaaggagcaaaacaacaataacaacaacaaaaaacacttcatctccagaagctgtaggttgacactgaaagaaggctctggaaccaggcaaaagacctcaggtttggcaaaatgaggctcccaccctgaactaaaaatgcttctcttgtttcccttttagctaatttctctcctttctgagtctacccaggggggtcggtctagcggatgctattaaaacccacagctgcaaaaggggagaaaaaaacagaggaaattttctgttgcttgtaatcaagggtaaaaataaaagaagcacaatgaaaattaaggaaaataaacagtgatcaaggcttttcttttccacttgcccgtggagtcctgctgtgtgtccaacaataggggaagaacaggactgagatgtgggattccgtcagctctcgctgcatgcaaggacagaaagatgcctacaacaagccagagttacgggactggggtgacatgactctcacaatctccttctcccacgtgaaaggtgaggccatggctatataacgagaaagctgggaagacagtacaggcagaggaaaggagtgatccaggaatgaatgcagcttggtccctggctgtgagacacaggattgcactcagatgtacccttcaaggtatccatccattcagatctcttggggagtgggcttggacttgactggaggctctcccatgaaatcatagataacctgatttccccatggctacctcttctcttctcaagattttgtgctacactcaggattccagcatctgggttctaagctgagatttggcctggacttcccttggccaggctgaattgaccacagcttccaatgaagccaacaaggatgataacctctgccatatgccacgcactgtgctatgagcccagcatacaattcctagtcctcccaaaagctctctgatgcaggtagatttgccctaattttacaaatgagaaaggctcaaaatgaaagtatgacaccaaacacatgaatccatgtctgtgtccttaatgttgacaaagagaaaacctgacttactacccaacgtcattcttctagaaagtggcagaacatagaaccttattctggtctgactgacctggagcccacacattccatatttctccaggagggtgctctgatagatggtagaagttgggcttccagactcactgctagaaataagaccaccaaaagggaagaatcatggcatgagtaggaagtgaattgaatagctgacttcagacatagctgatcagccatgggacacaaaagcagaaagcaataagagagaggcactggaggcctgggaaagtgttagaagcaagaaggataaagaatagagggaaaattggactcgaggtagccaagagactttctcattttcacccataacagatagaggatagagcaaagggaattggaagagaggaacagagcagttcagggtgtgtggttaccttgcagtcaatgtctgaggaagatcagaaattctcagggaaccaaatgctgtcagttctggttcactttgtggtaaacactgtgtagttctgctgctggaagcacccctaccctatcaatgctgaatgctcacagcttcatccttccctgggaactctctcagccaagatcatgtttgctttcttggaggtgagaggacatggctgatgactgattggtttgagaataaaaaagtctggtcctctaacctcagtttgggggcaattctaaaggagcatcccagctcctgggttctcccacagggttgactgatccctcggttgtaactacatcatgagtcagcttctccctctgcccagcccagcctcccccacttctttacaggtgggtgtccatacagctttcccaaataaatcttctgcacccaatctctgtctcagattttgtttctagggaacccaacctaagatactccctgtacctctgtgccccccaccacccttcaagtaatcttgagagaagacctacagaatggaagggaggggtgcaggtaaaaggtgaagcaagaacatcttcacctagcctgcaaacacagcctccccttgtgcaaccagattcctctatggttccacgagccagctgcaagatttccaccctggttctggcaccagacgttcagcgcagtctaattgcaccaaattttatttgagtcttcgctggggctgtcacttcatccaattaagtggaggttacagaaggatccacttgtcattacagcaattcctccttgtgctaaatgcttccagaatcttaattaccgagcaggcaagatcagaaaagatggctccagtggagatggtagtatttctctttcacaaacacaggcaggcccccgagcctgacatgcactacccatgtacagccgctacataaattagacaggcctaaataagtcaggctagagacaggaatggaaacagaatgcagatgaggctcaccaccaggcccagcactgtgtgaaggttgtgcgtccacattgcttgggcagcatggtacagcagaaaaactatggagctaacagctaggagacatgcaccctgtgctctgctctttgactggtgctgggatgtccagcaagcccctttccctcccctgtggcctctaaggtcttaagtgatttgattcctgattatccagcctccactcccactactcacccatctatcccagccacatcaaccaccctcagtcctttcaacatgccacactcattcctacctctagagtttcccactcactgatccctttccccataaaggtcatcttcctactctttaaatggctgacatcttctcattctccaggttttaaaccaaatgtctcttcctccaagaagcttctcttgtccacttaccgaagggagccccctacttactttctgtcgtgatgctctatttgatcccaacaaagtctcaatcacaatttgtaattctatattgttccattaactctttcaaagtccatctctccctgtagaatagtgatgcccaatatggtagccaccagctatgtccatgtgcggctatttaaacttttctaaaaaaaataaataaaatttaaaattccattcctcagccatgataaccacatttcaagtgtttgatagccataagtggctactgagccagagatgccagacagcacagatacagaacattccaatcacagcagaaagctctattaggcagctctggtctatagtatatgcttgatcagtttcattgacccttgaatcgaatctctggatacctatccatagtgcctgggtatatactactcacgcaataaatatgtgagtaaatgaattaacaagtgaacaatgcatattttaaatagagatatgtttggcagagccaagaaggaatgttcatttctgcttggggaagctgtagaagtcttcacagagaggatgacatctaacatgagctttgaaggatgactgcgagaagaaggtgaaggggcaggcatagaacaaagaaaaccacagaggtaaaagcatcaaatgatgaaagatcgtgctgtttcatgcttagaggtttggcaagtttcttgttgcaagtttcttgctgcaaagttgattagaactcaggtttcctttcattgaaagtccgatgcttgggggctcaacagctgaaatatttgcctcagggcccagaacttaaacgtggtggtaaagtattatctctgaaaagaaggaaaaatgtactgatttttaaaattcaaggtgaaaagggaatgcagatgttcatattttaatacactacaaaagatccctggatacttatctcctggcctacatcttccttgtttttgtattgcagacatactttagcatacacaggttgtatagaagacaaagtaccagttttaggatgaataaatgggaacactgatatctcgagaggccttctcagcatggaaacacaatgatgcaacctcatgtggaaataaaggtgctttacttccaccctcacttacttcaatacgctggcacatgcttgctttcaagcaactccctctctagacatggggtttaaccacctgccctgcagatgacgtgtacattctgacatctgcatggaaacaaggtaactcagtcttagaaagccaggagggtggccaagatcacagcgggaggatggagcaaatccttgggtttatgtccctttagacgaggggggttcactctcttctgaaacacgggctcatttatacaagcaaacagatcagaacacattacaggaaggaattcccacggcatgcgctgctctttgctttgccttgtgaagataaaaggaggaagaaacaaaagacttagagagcagagctggtatgaaccatgaagctgctctacattaatcatctccatcgcccccacttcctgctgcccttctcgacataggccctgggtcttttgctgggaaaaggcaggtcgaactggagctggctggggagctcattagcacctcgccagagccgagggctgcctgccttccaggaggcattttgaactctcccttcagttacttccttgcaatcaatatgctgcttttgcagttgctccatccactgcccttgcagccatcggaggctacaggcttctaagaagaactgttggggtttatcaacatacacatcttcacttcacaggaagcagcattccatggtttgcacattggtcctctgggctcataacacagcagggtccagatctggggagaagcaggcacgagggatgtactgggagtagggaggaaggccttggccaggtgctctggcaatgtgggcaggaaaaggccttggtggcaatgggtgttgcatgaggaggtcctatggtcagctcaggcaaaggcccaggagtctcaactgggaagcagaccctgaagccatgtctcccaattcagacctaggggccctgaaacgctgtgtctgagatgcttttcccttactgattcctgtaatgcctgagccagcttgtagctgtcatgcatatggccactagggaccaggagaatttgagttctacatgtggcctggttggccccatccctctgggaggtcatcactacagctgagccacaagatcctgggactgggatcctcatagacctctgggacagtaggttctggggagtgacattgactccaaccctgcaggtgtagccttccagaagccagttcctctctgtaaaataaaggcatataaaggaccactcttagcccttccaatcaccagcaggaacccaagagagagtccctctagccctgagagtctccaatagcatcatccttcttatccaaatccaataaagcaatgctgttcttcaaggcccactgaccacaacctaatggagagctgaggctgccagataccaagacttagcattatagaagggcagagcatggcaggatcccaggggaaaagaattagcacaacctcatacaaaatggagtaataatacacctacctcagaaaatctgctatgagaattacctagatcatctctttaaagcactgtattacttagctttttcttagtgacaaacaaccccgaatcttgatgtacgcagatacttgtttcttgttctcagttagctccaggctgtgtttgaatctattccctatgcctctcattccaggaactagtctgaaggagctgttgctgccaggggcaggttcttccagtgacggatggcagcaggcaacagagcaagcagggacacatgatacctcctgaaatctctcctgggaactggcacaccatcccttctgcccacattctacggttcaaaccaagccacatggccaagctcaaggtcaatggggctttgtcaaagccaatcaggaagtgtactctgcccatggggagggatcatgaagagtgaatctttgcagaaaaaccacacagtgttccagaagtgctcaataaggaattgggatatagtcatctctcagaaaatgttagttattatcaacatgtgtattactatcactattagtaacaggctttgctgatgattcattgaagctcagataaggttgggttggatgagacacagtttggagggctgctacttgggaatggccctgggaaagcttaacctctattgcttggtcaaggtcaagactgactgtaagaactgtgatggagccaaatgtgactagaggagagggaaacggcttcagccaggtcaggcttgacccctgagctgtccttaggaccaggaggaattggaggaaaaggcatcccacggaaaactgagttcatggcagaaccatgacttaaacccagattgccttactctaattctagattaaatccctactccaccctcactaggagaaagaacattttgagatggaattgattcctttctacatatttttctttaaaaaaaaaaactcagtgtttatttttatttcttttaggctgaagcttaactccaaaaatagtctttttcagtagccctgtcattagcagttgctacaaacactatgtcccccacacattgaactgcacgcacgacacttgaaaagagcaattagaacagaagtctcccaagaatcgcaaggaaggcagtggctgcagctcctgatgcctacagtctcccaaggacatggctgggagccagccctgctctggggcttctcgtgcctctctgtgggtcgcccataccctagcatttgctccgttgtgtgcctgactctgtgctaaccccaggagaacttgcagccactcggccctcaacttcactctagttgtctgtccttaaccttaggtcttaatgtagagaggtcactaagcctctctaagtctctgattcctcacctagaaaataagaatcataataattttgggatatttgaggcatcctcatcattttgtacacatcaaagaactatttgatttcatgggagtgccaccaactgagctcctcctatacacagggatactgagaataaacagatagttggacacagcccttaccttcgaacaattatagtctagcagaggttcctgctgttgatttgggggcatgtaatatagtttacaatggtggggaaagtttcaggtaagacttccctgcagggaaaatacatgggctgaattataaaatggttgatgaagtagggaaaggtattccaaaggaaaggagcagcatgtgcaaaggctctgaggctaactagaactatctgggctggtctccagcctcgtgtgcagtgaaaaggtctgaaggaaaagatatcgtgaagggctttgtccacctttgcaaagaagcagcaagtaatagagaagtatccaagccctgcagttgcttcatttatgcaacaaatgtccactgagggcccacaatgtgccaagcaccagggacacaggccgagcaagcacagacccagtgcctgtcctcgtggaacccataacctaatgaacttggcatgtttgctatacatgtgtagtttcaagaagtcaccttggataacaagggtggtggcattggggaattagaatttgtgtggtcaagaaagggggttcatggaaggggttcctgagaactatggctggagagagactatggctggagagagacacggggtacaatttatgcccttctgtgggcaatagggccttggcaggggaagggggcaggctctggcctgacagtaagacaaaggaagaaactaaaagatgaggagagatggaaggagggaaggaaaggaccagcccccagcctctcagccagacctcatcacactcttgtctgctgtgaatctgtggtcacttctcacacctgggaaggtgcagacctctgtatgggcataaaaggaggcgtctgaattcttcagaagcaaaaacatacaagaataacccaaaaggagttgggagggggatttcaaattcatgaaagccaatacacatgggtgctgcggattcaattgtgtcaaccagaaagatatgttcaacacctagcccctggtacctgagaatgtggccttatttggaaatagggtctttgtagatgtaatcaagccaagatgaagtcctactggaagaaggtgggccccaaatcaatgactggcatccttctaaaatgaggaacatttggatgcagaaacacacagagagaagaaggccatgtgacgacagaggcagagacaggaatgatgcatttataagccaaggaacacccaaagatcactggcaaccagcagaagttagaagaggcatgggctgggcatggtggctcacgcctgtaatcccagcattttgggaggccaaggtgggcggatcacctgacgtcaggagtccaagaccagcctggtcaacatggctaaaccccgtctctactaaaaatgcaaaaattagccgggcatggtggtgggagtctgtaatcccagctactcgggaggctgaggcagggagaatggcttgaacccgggagacggaggttgcagtgagccaagatcacaccattgcactccagcctgtgtgatagagcaagattctgcctccaaaaaaaaaaaggcatgaaacagattctccctcagagctatcagaaggaaccaaccctactgacacttggaccttggacttcaggactccagaactgtaagagaatatactgttgtctaaagccacccagtgtatagtagttcattatggcagccctggcaaactaatacaatagtaaattatacctcacaattgtacagattaaatttggatgggtcaacagccttaggggtggcaagttgaagtaacccaataattgcattcagatatacttagccccaccttgcaggacagggccaggaagtagctggtgttagcccgaggggtagggagctgctgactcctgttctggccacatcatctcactcatacctcacaacaaacctgaagggtccacctcactgtgctcactttgtagagggtatgacaggcttacagaagtgtaggtgcatgccccgggtccatgtggcaagtgccagagctgggatctgaatacaagtcatcctgtgacttgcttttgagccgtaaaattataaacaagcagttagttcccgtccacaaagcattcactattcacagaattaagaatgacattcttggctgggcatggtagctcatgcctgtaatcctagcacttgggaggccgaggtgagtggatcacttaagggcaggagtttgagactagcctggccaacatggagaaactgagtctctactaaaaatacaaaaattagccaggcatggtggcaggtgcctgtaatcccagctactcgggaggctgaggtagaattgcttgaacctgggaggtggaggttgcagtgagccaagattgtaccactgcacttcagcctgggcaacagagtgagactctgtcttagaaaaaaaaaaagaatgacattcttaccactctctaaatggtctcacttatgagctcatttttcttctcccctccattagaatatctgcttcaaaatagtcgaagccctgatccatatggctgtttgctgtatccctgtgtctagaagattactggggcataacaggtatttaataaatatttgtcacattaatcagtcaactaatagggggcatttggagactaagatggcactgtccaggtgtatatttctatactaatttaacaaagtggcaaatggggctgggcacagtggctcacgcctgtaatcccagcattttgggaagatgaggtgggcacattgcttgagctcaggagtttgagactagcctgggcaacatgatgaaaccttgtctctccaaagaatataaaaattagctggctgtggtggcacctgtagtcccagctactcaaagaggctgaggtgggaggatcgctgagcctgggaggttgaagctgcagtgagccatgattgtgccacagcctaggcgacagagtgagaccctgtctcaaaacaacaacaacaacaaaaacaaaatggcaaatggtactaattgcttgctgtcctcaatcaaagaatactcaaaggaaaatgttaatgccacacatttgtgcaggctcgacccctgcacctgagagtctgcagaagccatggccaacagctccatggcagtggacaagacaggtgtcacccaaaacattggtgtgtaacaaggcattaataagaaatgaaagggagagataaaaaaaaagcaggatttacagggaatgagaaggaagggagaacaggggaagagaggaggatgtggtagggggaagagaggaggaagaggtaggaggaagaggaactgtttttcaggagggactatcagtagcagcagacactgacaagcatggcagtggtgagccaagttacctgtttgtgaccttttgaatgcataggaatggttgcaagagagagggaaggggcagaggctggcggacactgaggagaggagaaagaaagatggggaagtgttagacaggaagtcagggaagcacagggacaggcagaaagagaagctgagagggactgagactctgaaatagacatagataacacaacttagttctgaacatatttagttctaaaatgggtttccatcagtgtgaaattcattacaacaaaaatttaaggtattaatagatcattctcattgttatttaagcctgaaagcaggagacacaaactacacaccacaacctaccaatcagccctaacacttcatgcggccaactcccttcctgctctattacagaaagtggggaggtgcatgccagtgggagccccacctatgcatgtcctattttggtatgcccagcattcctattgaggggaagggctcttgtctcactttgcatcctcctggagggcctgggttcacacactctggctaaagaattgggcacatgacttagactgggtccttccatctgccactgggcagatggtgggtctagaatcggacgctcaaccctgtcagggataggcagaatccttccctgggactggccttcagacatggggagacataatccttttgcccttgaggttgttaaactacaaggtgtggatctggagatgccagcccccaaatggcccccaacttatcccatcagcatgtaggataatagtgccaatgaggaacaaacaaaacagaaaatgacaaaggagacaaagccctgggtcctcatttgagccctaggatgtgatctgcacagagacagctccatgccagagcattccagggacgtgggccaacaaccttcctctggggttttatccagttagagttgggtggctgccacttaccactgccagggtccaggctgagaatggctcctcatctccatcctcctgctctgtgcagcccctgccgagtcctcctgcccttaactatgtcaatgaccgcacagttttggcaggacaagagcaggactatacgcagtgatgtcccagcccaggtaggtgtcaaggactgaggcaatggcaaaatccatcctggcagtgaaatggagccctgcttccgagatgcaaaagaaaggcagggaaaagtcatgcatctgccagagggaattaatccagagccagtgggggaagaactggcaagtggggctggcagaaatgagctgtgcaaacaggtcctgaggcaactgtctgctgtcagactgctctaagagcctccgaggaaggagagagaggggaggagccagggcaacatggtaggagaccagagctgccaccaagaacttcttcctgggatggcaagggcacttgtaagggcagaaattcatcagatcccattgaggacatttgtatttctatgctataaaccccttccagtaccctaaatcctcagaggtctattataccccaaagaacttgagagagagagtgtgcatgtgcatgtgcatgctggagaaaggataaagaatattaaggggagctgagttccaaatttggaaggtttagagaggacagaaggtgtaaggagtgagagggaattgaggatgaaagtcagaaggaatggtaaacagatatgtcagaagtgaccatagaagaaacccctaggaataggcacaaaggtaagagagagctaatgatactgcaatctcaaaggtcatggtaacttctgttggcatcatggttgataaatttgggactgggtgaactcttctcagatgtagccccaggaatgcctggcatgagcccttttgtgcaaaagcaatcactacgggtatatccatgagctgtcttttctgttcttttttttgagatggagtcttgctcttgtcgcccagactggagtgcagtggcgcgatcttggctcactgcaacctctggctcttaggttcaagcgattctcctgcctcagtatcccgagtagttgggattacaggcaaccaccaccacacccggctaatttcttgtatttttagtagagatagggtttcaccatgttggccaggctggtctcgaactcctcacctcaggtgatccacctgactcggcttcccaaagtgctgggattacaggcatgagccaccacacccggccttttctgtgatttctgaagacagtagggcaattccttgatgacatcatggactagtagtcaaccaagagtcttatggtcatggttggataagagagggtgagaaaggtggtagcttggagttggggtggtaaaggtaagggccataggcacaggcaatacctagacgtactagatacgggtcaataactgctagatatgggttaagacctgggaggagggtaccctgtagtttccttcatctctgcttatctcagaagtcaagaaataaaggcaacagagcctggaattcagcagatgcatgcaaatatatctgaaaaagttggttggtcacttaattaactatattaccctaacttgggacaaacattgaagaataaaaggtggcggtcagctcacagaggtgagtcatagaagaaaagccacagagatgagtgcagatgtgctcagggagaaggagcgcctttcagacaattgaatcccaatagcactgtgggtagatacaatcagctaactccgcctactatgagaccagacgcagcaaacctgcttctgatcactgttcagctcccacaaaatgctgactggaaactatggcattgtctgcatgctgtgggtatctgtccactgcatagatggccagaatgaggtttctaagccatcaaggcgagaagggccacggtaacagacagagcctccctgcagtagcaccacctgccccgccctcacgggttggacaagtcacagttggttcagctttttctcattcccatcacagcccagtgaagttactggatgaggagaggtggtgctgtactccacatagtcattcagggacccaggctccgatctggagctgctgcctgacttaatatgtggtctcaaatgtcacagcaggaggggaaaaagagagggggcttgcataggggagttttttaataggtctggcccaaaaggagtgtatatcacttctgcacacactcctctggccccatctgaatggaggaagcttgtgtgcccagaaggaaaaataaatggtacagagaacgtaacattgtcacacgagtctttgaactttcttgctggtatgaagcaggtcccacactctgcgatttccacactttatttcactgatcctcagaaaacatgaggcaagaaacatccttctgtccctttctacagatggagaaactgaggctcagtcacgtgcagagttgcattcagcaacataaaatgaacagagccaagaatgaaccccaggtttgcctgcttctaaagtgcagcctcctcacctccccttacgaagggcctttccaattgcttgctcaggcacagcaaattgcagccctgtcttgctggggtcccagcagttcctcactcacgtgcagaagagattaaaagaacaaaccacagagcacattttgccgctgattaactcaaagaggaggctttccctcactgagaacagatgatcagctgctctgccaataactgcctgctccgtaccaccaggccgcattccatcaaaaaggcacagtttccatttactgggttgaaagtgagtcacatctgcccctggatagacatataaagcaacaggcatgctactctgattaataatgaaaagctggtgcaagcacatttcattttaaaagagaagaggccaaatcctagcctccttttctaccaggtttaggaaagcatgaaaaaggagaaggatcatatgggttaggggggaaaaaagaaactttaaagaagcaaagaaatctacctgcccaagaggtgggaaagcagagattttattctattctaggaaccttgtgattctgcagagctgcatcgtttgttttttatactattttagaaaggaattccattgttttaaggcgggaataagcgtgaagcctggccttagaatacaacccattattttgacaaatagtcaagtcaaggccctgagcaatggtcacttaagtctaattagcaggagaatgaaggccacatctcttcttaggtaaatgtccgctaagcacggcttctgagctccctggatcaaaatgagcacatgttgtgcaaggggcatgggtgaagtttaaaaacaatacaacgtgagcatactgaacctcatcgattacattgggaacccacagccaccccaactgttgagatacggctgttttcggcatctgcttcctgagaattgctactgttttgttttttcaatgtttgaatgtgttgcgacgatttcttcatgagaatcctttctaaatgattggcggtgcttgtttttgaactgcaaaatcttttactctacctccttttctccacccacccacctgcggttggagtcactgggttgccggtaggtggaccaactggcttgggctggaagctgggtgaggccaggtacaaggacagttcccatgaccagctgggctggctgggactgttcacctggacaccctacctcatgtaccaggccctgcctgacaggaggatcaccagtcctccgactcctagtgcaagacctacccttcaggatcagacttccaagctgccacatctggccagactctacctgagttcatgtagttcttgggcttcgtggccatagccaagtctgtctctaaccccttcccataacacagaacacacaatttttgccctcatgtattctggaatttgtaaagtctacatcaagaaagaacatttgggaggagactttaaaaaaaaatcttcaaaaacaatcaatacgtgacaagaaaaagataattgctcagctttcagatcgtacagaatttggacgtttaagcccaatatcagtgggaaaggaagaaacatcttcccatctgttttcaggtaggctagaaagttttcattcaagacattaagcctgtgggggtttctaatggctttttttgatccaaattgtattaattaggaaaatactaattgctgtaacaaataaaccccaaggcttagtagcttaacacaataatagtttattatcacttcaatattaataacaggcctgcttagcagacaattttcctccacaaggtgattcagggacccaggcgtgttcaatcttttgactctcccctcaccttgaaattgtctgcatccagctaaccaaagaggggggtgagcagatgaggaatgactacatgctttttaactctttgactctgaaaggacatgcagcagttctgctcacattccttaaactggaactattatcacagggccctagtgattgcagagcaggctgggaatgaggtccgtggttaggcagctgcttcaccactttatcctatggaagggaggcacatgtgcttggtgggcacttggccagctttattggcctgaaaggtagcagaaaatttctctcagatctcggaaatggggagtcagtctgcatttaccttttgctgtatttccctggatagttagtggggaaatggcagagggaaggccaagcatcactagtcagagtaaaccagaagacatatgtcaattttccagaaagggattctggggctcaaataagtggaaccacttcttcacagccacgtcaccagctctgccttcccatccatacagctccattggccagaggcccacagaggaagtatcttcccatccagtttctgcacctggcgtcctagatgaatagtagggcactaagtacaaaagccttcccatggggcaggatctgggccagtacgactggcctttggagctgggtcattctttgttgtcagggggccatgctgtgtatcgtagggtgtttaacagcatctctgggctccacccactagatgtcagtaccccccctctcccatcgtgacaatccaaaatgtctccagacattgccaaatgtcccctggaaggaaaatcaccctcaattaagaatcactggtccaggcagaggctgcagtgtttcagagataaattaggctccagtgactggacaaaggcaatgatctagagcattcttactaaactggagcccatgggtttaactgagtttagcctagcctggaacttgggttctcagaaaaaatattccatatatatctgtcacggaataatacattatggaaaattagcataaggagggtcagaaaatagtctcatttatgggctcattataggaagagggcaggccttggactgtgtgactctgatgagactgggtaatcagacttcagcatcctcagtggtaacaggggaccatggtgaagattaaatacaacctcatgagaagacagtcagtgaagtgtctggcatgcaataaatggtccacaaatggtagctaactacagactttgcagcttgttccatacctcagatcattcttccatttgaacacaggagggtaatgttccaagtgaatgagaatttaatgcagttgccatttgatttaatttccaaatgcgttaaaagtgttaatgcaacacatcagcatgcagctgataaagtagtcaaaataattcaaggaaaccaatacttatcaggttttatttatccacatttacacttttttaaaaataagctggtctttgtgcccatatagattacaatatacataatatctcccggttagcctcccctccacacatatgttcaagtgaagtttcccacttttctcccatctgtcatttttctctttccataaaaagctaatggtgacgttatcaaagagtgaaggagtcagaggctaagggtggggaaccgggcacccatgaggaggatggggaatgatgaggagaagcacaaacataggcacgcactttgtttaggaacaattttcatagccatggcctctgacccaaatctaggggagccggcattattattccaattaggcagtcatgaaatgatggtcctaatccacttagctaacacaaggcagaatcaggatttgaacccgagacctctgatttgctatctatgtgttcttgacaatagcagtcatgggaaaaaaaatgatgcaagtattattaataaaagttaagaccaaagaaagattaaaaaataagaaccaaagcaccagcatattttcctacaaagaatgaaactcacgcagaagatgagcatgttgaggtttctctgctttgaaatagggttccaggaaagtcaagatcaggcatgagatgagaggaggaggtaagctaagtctaccacaaaaaaacttccagacctaagttggagcatatatgatccatatgcagggctcttgggggaatgggtagaactcacactgaggcaagccttccttgaaaaggcattgaagaaggcccaggagtttttaaaatgaccactctaaggggcacatggtggggtgggtaagtagcatggctctggcagggcaactgagccccctaaatttgtagccaaatcagagcaaagaaagaccataagaggagcacagggaattacaaagctcacagctcccataagaaggaagaaaagaattaaggaaacgtaatacttaaaggaaaaggtaaagaaacagatacctataaaggagacagaactttctcagaggtagaaggaaaaccaggagctcaatcaataacgagaaccttaaaaaagaagggatggtgaggggtctcgtcacatgcttgtaaagtaaggacctgagcactcttccctggatacagcaaatgtttaagccccttctatatgccaggtactgactcaggtactgctggtctagcaggaaataaggcttacaaagcttcttcctccaggagctcatgttctagtaggaaagatgggtaatccacaaatagatgtaaattacaatgtcagatagtgacaagatctaggaggaaaaccaaagcaccctgcaaaggaacagagttacaaagggaaggggtgggaggtgggggagagtgttatttcagataaggtaatcagagggggcctctctgagaagctgaagtctgagcagagaccagatcgataaaacaagtgagctacataattatctggaagaaatgcatgtcaggcaaagcaaggacagcaagtgcaaaggtcagaactagtttggtgtggttcaaggaagaggaaatggatcagcatggctagaaaagagaataagagggcaaatatgggggtggggcattacaaatcaaggactagatatggagaccatgttaagaagtttggattttattctgagtgtgacaggaaattctggaggcttttcaacaggaaaaaagccattatctaactttttcaaatgatcactcaggctgctgcattgagaatagacatcaatggggcaagagtggagcagggaggaagctggaatagtcatgcagttgagaacagaatagagttttgactcatgcactgatcagcaaactgtggccaaatccagccctctgcctgtttctgtaaataaagttttattggcacataacccatgctcattcatttgcatattttttatggctgtttttgctacaacagcagagttgagtctttgctacacagatcatatgacctggaaagctgaaactattgactctaatgccctggagagaaagtctgccaaccttgtcgaggatgttgacaatagaggtggtggaaggtggcaggctctagataaacttaggaggtagagcagaggccagatgttagcccaggctctctgataccatgcctgctctctgatcactgggtgatatagccctccagctcctctttacttctgaggacttgtggagaacgtgaatggaaactctggagtccagtctgaggccagcctttgctttgttccactccctatacaagcacagagctcaaggtggctttgcctctcctcctagcatgagcttgtcctccatggctgctgccaccaaggaggcaggagccagcagccttggtcaccttagaaggccacagaggctgtaggatccctgtagcagaagctgttgcgtcccaccgccacctcaggacttattattgcaccgagtgcagtccaacctccaactgcctctgccaactgtcaaatagctaatagacatgggcttctgccaaagccctggggagcggggggttacatcctgtatgacaagacagtaaagccagaaaattaagacccccaagagcagctctcaaccaatgactggagggggttaaggtacaaataaccccctcctccacaccccaggggttctacactgaatcccagaattacctagtaggatagagctccagacggtcacagcagttactcacttgagaatgtaccctttattcgctgcccttgattctctgtctcatgtccctaaaaccaaataagcaccttgcactcggaactcctgccctgagtctgcttctaggggtctcaacgccatgtgccttttatcttcactcttcttttccaacgcagtctgtgccagtgaccatagccagctgtctgacaatggtttttccctgcaggaccagagaaaggaagaacagctggatgcagagatcccaccttatgagtgtgcacactactatccatggccatggatagggtccgtcacagcccctagactactacaggatgaagcccaggctcctattctggtacaaagactctgcaaatgtccccttgcctacttatccagccccaaacatgtcacccactcagtgtctcaaaactaacccaggctgtcctgcttatgagcttgccaagccacaggacccatctcagatggggccagtcggagaggctatcccagactcttccagactgcgctcattgttccaacctctgtacacctttagctcacacctgaatgcagggtctaccatactggattttgcaagaaatgtggtataaaagagacagcatggccaaggcaaggcaagcctagctctgccacttatgagcagtatgatcttagaaaggtccagaacctctctgggtttccatgctctcactggtaaaaggtggttgctaacagcacctacgtcatagggccattgttaggattagggaggtagtgtggcaggtggctaacattaactgaccatgcagcacagatttgcatgattcttcctgctagaccatgagcttattacagaacctgacacagttgggctccataaacctttattaagcaaatgaatacaggaatgagtcagctactccaggcattccatctttaaactagaggctataaatgcaaatcactgctggcaccagactagtgagagagcaaaacgggaccagccaggacagcagtcaacggtggaacgtgtgcttccaaaacagggacgctgaggagcccactgttgccatcctaaaatgtaggctccaggtagctatgcctgatacagtctcaagaaacttgtaaatgctgaaaaaaaacttaaaaaggaaagagaagacagtacaatgtaagtaaagcactttcgcaactgacttcaaacaatggattggattggatgacctcaatcccatttcagaagagggagaccttaagatgatctaaatttaaattttcatagtatgtacagaatatcattcctttaatccaggaaaacaaacaatggacaatgtctttgggaaacattccttaatagtaatgtaaaaaatatgattactactaaagacataattttatactttctagtactaggatgtatctgtttatatatgttacatatatattatgctatatatatgtgttttatatattatatgtatgttatattttctccctctcataggacctatttatatatattcacctccattattcagataaggaaaatgacgcccagagtaaatacatgatttgctgaatcacacaggtaccagggagcaggactaagatggaaactcaagtgtatttagaacaataatccctactcttgatcctaacaacctcccttggtaggaagtcacatcagtgtttaaatcggaacctctaacagcactagtatcacatttcttctgagcactaattctcatactgatgagtgttctgagtgcataataggttgttaaatggagttgaaagattggtttaaaaatcaccaccgacaagaaactttttatgaattagaaaattttcatcaagatacatctgcataactttggttgcagacactcaagtccttgaggccagctaagacaccttgaaattgaagacactcagaaaaccagaagcaaagcaaatgaataagcatttgctgagcactggtctggaccaggtaggttgaggggccgaattgtcaattgagcgaaacctcaattacagagtaatctaatgtatacccaggtacattatcacaactcaataaacagctccccagaattaagtaattccaatttgctttcatttcggtctgtgtgtcgccctgagaatttgatattacctaccctcacattaggcagcatcttctgaagtgctaatctttaccatctcaggatcacacgtgagctgtgagccagtcagccatgaatacgcctgtttggggagaaagagagaccagcctgggcctctgctgttcctctcagcctgagtacctgctgtggaagccagcacaggggtttacagctcccagaaccctcgggtgctgaagggcccagtgacctcccaactgtggagtggttagggttttgaatgaacaataccaggagaggggtggtccatgtaactagatggctgagcacaaacaaaactagctacttttcctttgtccccagacccgggaatcagctttcccgatccagtaggggtgaacacaggaaaggaccagagaattctgacctacagggacttgtgatggttaatattaagtgttaacttggttgaaatgaaggatgcaaagtattgtttctgggtgtatctgggtgtttctaggtgttgccagaagagattcatatttgagtcagcggactgggagaggcagacccaaccacaatgtgggtggacaccatcccatcagctgccagcgtaactagaaaaagccggcagaagaaggtgaaagaagcggacttgctgagttttcctgccttcgtcttcctcctatgctgccctcgaacatcaggcctcaacttctttggcttttggagtcttggacttacaccagtggtttcccaggggctctcgggcctttggccacagactaaaggctacactgccgagctttcctacttttcaggttttggaactctaactgagccactactgtcttccttgctcctcaacttacagacggcccatctgggtcttcaccctgtgatcatgtgagtcagttctccttaataaactccccttcatatatacatatatcctattacttctgtccctctagagaaccctaataaaagaccccatgacccaaatgtcccccagtccacactttcatatttcctccctccctcttcttatactcggcacatcaccgtgtaccaacagagaactgggccacactttacagaacaggcctgacatgatttccccaaagccacagagacagtcatcaaatcggcacctgggtccaatgtcctgtccccacccatggagtccttcatctctcttacttctttgtctgataaatcccacccctatgggcaatttatttattttatttaacaaataccttagagtgcctatgcagggcactgttctaagaactcctacatccattatcacatgtcatcctcatgacgccttctgagggaggtaatcctacattcctgttcccagatgagccagctgaggccccaagaggttagatcatgttcaaggtcacagagttgggacaaggtggggccagaattcagacccaagcatcttggctgcagagttatctcctgccctgaactggaaccaaagggtgggaacctgtgaggaggaagaccttgaagacatggttttctttctgtgatatcccagggttgtgggtgacgtcagtccaagaaggaatccagatcccatcccataacacagcacttggcccttgagaatcctttttcttttttggtctgtttttcagattttctcccttctctgaaagaaggaggattaatgcttttcccttgtatttttttaaacaagtacaaatacttcagtattaaagtacttaagcatcctggctccgcaaaggcaaagggctcttgagaggtaagtgagtcattcttcatcacacagtttcttccaaacgcttgggtttgctgccttcaaatgggtccctgggcacccactccagggtgacaggtttcctctggttgcttctgctcctgagggggtccctgccttttattttcttgttttgcttggatgccactaactctttagcagtgtgtttggggtcggggcagggggtgagggtaggttaaatgtatttctccagcaatctggaagttagctgacagtcaggaagggaatatcacgtgtcaaaatggcaagttagctagacggacccagggaatcctgcttgcctggtacctgggccccttcagcactgctcatgacattgtggcaccaggtaacagcaagaccacaacccaccagccctccaggtgtgaccaaacagcatgagccagatgcaggtcggactccagttgtaccccttgggatggtcctgtttctcaacctggctgtgctaattctcccactcatgaaatgagttaaaataaaaccaatgtacagagctgcaattaggaaaaaatcaggtaacatatgttgaagggacttctttacatgcaagggaccaggctcctagcttaccaccatcataatatttaaatggaggaaaaatgggcactaaaaaactgataacctatgccaaaaatatggatgaatttcatcgatgtgtaataaaattacaccttgattgaccagattacaggaagtgccaaccccccactgttcaatgtgaaggagactgggtgccacccaccaccccaccctccctaagctggagtggcaggggctgcaggtgagtggcttcagagcagtggtagctgcggagtcatattgccaggcctggctactgcacccaggctagcaccagcccctcctcttgacttgggcccaggatgcacaaccagcagaggacaaatcagtgtccccgtaaaccctggccacctctccgaataaagcaaggatgctccaccacatcctctgtcccagtagcctcttggtttctcttcccatagctcccatcctgcccctgaatgggggcatataagcaaataataaaccaagcgttttctggttccatttgtctgctcatgggaatttcagagtgctaaactaactcccatagccactggtcacattcttttgccaccaactttgccccatgtacatgcaaggtgctagcaagaccatgaggagcgggaatgaacacagcacaccctctcctgggactctcaatctggtgtgggagaccagccacggaaggtataagacacattccagcaggacatctgaaaatacacattcactgagaacctgaatggcctgcaataacccctgtgtcacataatacaaatataataataataaatcttcaaaaaaaattttttttttgagatggagtctcgctcagccgcccaggctggattgcagtggcatgatctcagctcaccacaacctccgtctcctgggtttaagcgattctcctgcctcaacctcccgagcagctgggactagaggcacgagccaccacacccagctattttttgtatttttagtagagacggggtttcaccatgttggccaggctggtctcaaactcctggcctcaggcgcatgccaccacacccagctattttttgtatttttagtagagacggggtttcaccatgttggccaggctggtctcgaactcctggcctcaggtgatcgatctgtctgctttggcctcccaaactgttgggatgacaggcgtgagccaccataccgggccacacaaattaatcttatggcatcaacaaagcaaagataggagcttaatgccatcaaagtggtggcttcttttctatgttaataacatttaatgtaaacaaatttaaagatttttaaagttttttttcataagtgcctaacttgttgatctttggcttaagtgttcatggcattgtggtgaggaaataataaactcctgctgaggccaataattcattcactcttctatcagtccacacattttttcaagttgagccttgtgaaatgactgattgtgcaagtcaaaacaggcgaacactaacacttcatatggtttagcaaactgagaaccagtgccaggcactgcgctgagtgcagggacttccaacccagcagacagccctcctctcacagagcttagatcctaaaaggggagacaaaaagtcaccaagtaaacaaataaaggcaaaccagcattttaaagtgtgataaaaactatgtggaagaggagaccaggtaatgagaaggaactgtgaccaccaggaagggaggtgtgggcggggggtcagggaagttctctgggagaagacgacatactgccatttcagctgagacctgaatgatggcacatgatcagccatgtgaatgtctgtatgaagtcaagacagccagcatagagaatcccagcctgcaacccccagtccagttggcccaaggatcccagtcacactgggtcagcaaaatgaggtcaaagtttccacacccacccatactttgacaaaggaaactaacttaggaggcctcaaaggctcgatcagtggggttttttttgtttgctttttgttttttcccttcaaacacaccaggtctcattctacagctagcataataagaaaagcttcattatttcattcactaaattatgctatattaaaattttaatcggcaaacataacattggtaaaatgagtacatccatacactgcagttaccagtgtaaactgtcaaaccatttttttttttttgcaaaagcaatattgcaacacaaagaaaaatccataaagatgctcatattcttggcctcccaactctacccccagggaatttatcctaaggaaataatctggttcaatagaataaaatgttctctccagaagaactccatggaggtgctaattgttacatacacaaaggaaagaaaaaaacaagacacgtggaattatcgaaatgactgcaaatgggggggtttaacaaaataggataactcattggatgagatagcatacgatcactaagcatcataacaaagatgacaaagttgcagaaagaaatgggatatctggctttttgagagaagcagaaaacaatctgcatattttaatggaaagcatgtaaacagtatctcaaggtgaacaagaacaagaaaattgaaaagaattgaatcaaggccagtggggtgaggaattattcatttcaaaagtccttccaaaatattgtcattgtattgagttttcaatttttaaaaaaaaatccctcagaaacaatagtacgagaacactgccacagcatgccacccaaatacaaggacatttgttcattctaactttaaatacaaaataaagccaaatttgaagatgtcttctgtgttatatattccacagtctttcacgtatggctcttgtatgtgagactcaagttggaatagcaatgcaatgttgcatgattttaccatagtttctcccgtttggggagtttgtgttggggagggaggccagagtgactagaaattaatctcctcttttactgaatgtgggggaggatcagcagatgagaaaaggggctttaaggcccattaatgccaaccttccatggcagtagaggcgcaggctggaggcactcacctttcacgatcagctccgcgtagttggacacaccagacccaccatcagagcggatcacacagcggtacttgctgacgctccgctgggcagtgtctgccacactgactgtggctgagaagcgcctgtggttgaccacacgggtgaccatcagggccgtgtccctgccattccattgctgcagaacagaggaagagagggagaggaggaatcatagcatcataggcttctaggtgactcccaacacggatatccacccatcctcacacccctggggctcaagactttccactataataagggatttccagccaggcacagtggctcatgcctgtaatcccagtgctttgcaagggctgaggcaggaggatcatttgaggccaggagtttgagaccagcctaggtagcaagcaagaccttgcctctacaagaaattttaaaaaatagccaggcatggtggcactcatcttcagtcccagatactctggagggtgaggaaggaggatcgcctgagcccaaaaaccaaggttgcagtgagccatgatcaagccactgcactctaccctgggtgacagaggaaggccctgcctctttaaaaaaaaaaaaaaaaaaaaaaaagggcaggagttttcatggctggtttgtgctaatgagctgattcaagaataaactttgctagtgagctgatttgaggacacaggcctggtggtaagaagagaggaaaaaggctccttctaaacactttggctcagcctgcatttggggctggcatgtagccccttaactttcctccctattttcctttttcccttaagcagaactcatagcattctttcagacaaacttcagcagacttagtgaaaacccagcccatggagaataaacaccgcctggctcacaggccctgtggctggtgccctgctaccccaccccacaggctctgagccccacctgccctaagctatcaccacaggtagggaggggatgggagccttccaacacctctcttccttggcacatgctcttttctctgcctggagggtctggtctccctggggacactccgtcttccgtaaaaagccacgttcagctcacagccatctctagtcagttctcacaactgtcacaccatctctggaatcttatctatgtatgatacaaactttccacacacatttgcccacaagtgttgcccattttacactgaaggactttcctctgttcatctttagaagcttgtctgaaagcttcccaagttggtagacatctctagaatcaaggtgaatacacgtgggcttttgtcttcagcatcctgaatctcaggagggatatcctgagtttgaacaaacctctttcacagttgcaggttatgagaactggtaaggcacatgcatgttggtgcagtttgagtggatgtttattaatgttattaactggatatttatctactatgtgccagcccctgagctgggtatttttgtataaatcttcattgtgtcttcacagccttgtttggggagtgtacaactgctgctcttctcagaagaaaaatccaaatgtctaacagtttaactaaatgtgtagagtacacaagccccttatccaggttttccaacttcaagtcaagcactgtttttactaagaccatattctcagtgcctgctttaatttgaaaacgtttttccccaaaaagtgaaattgactcctttaattatctggacttagggaaaccttatgacttatgattctcatgccctgagtctcccagtctcgcaacgcgatcttcattgtttcctgcaccaagtaaacagtttccccatgtgcataacctactttcatctatgtcatctttcctcaccctctacagtgacctgtcaggagaggggcacaggtacaggtagagccacactgctcagctctatggcagcaaatgaggggagaccaataccaggggaaggcagtgatcatgaaggccagaaacccagggtatcccaggcccccatcaaagggcagctaagagagacttgctccaggctacaggctacaggctccaggctacagggagattgtaggtaatattttgctgctgctttttactttttcacattcttcaaactttctgtctcaaacacgtatttgctttatacttgaacataaaaaaaaatggtattgttcaaaagccatggcagaatgagaggcagccataactccctctcatgccagaaactaaccaacatgtggaatagttagtacacatcagagcaacatgcatggggctgtaagaggagaatctgaagccaaatgccagctctgcagcttccaagctatgcagacttgagcaggcaatttcactgttctgagctggaaagtttccattcgcttgcccgaataaaaaccagtacaaggtaatggaaggggagaaaggtcacttgggcggaaactgccatccagcttcctcatgccttgaggcatctttgcaggagatggcacaacttggaccccactatgagaacctaggagacaccacatgcaatgccccggaaattcccaaagtagtgcagggagaaaggcgggaaaattccggcaaacaccaggaatgtatcctgatttggagaagagatcacttaatgaataggagggccttggaagcagggggtcatcaaaaggagcccatcttccccactgctgagcaaggcatttcagggccaccatgggggataagaatgagttagtggtgaggctttggctcaatattttctaatatgagttatttataacatcataaacacttttattttttctttattaagctaataacagctaaacactactatgtgctaaatgttttatatgctttctcatttattccccatgaaaaataaggtaggcacacttcttatcgctgtcatatataagaggaaactgggctgggcgtggtggctcacgcctgtaatcccagcactttgggaggctgaggcgggcagatcacgaggtcaggagattgagatcatcctggctaatacggtgaaacccagaaatcaggtagcataaaaatgcacagagatacaaatgttaggatgtcaggaagatggagcaagacattgaaggaaagcccaaagtcctgggaaatgccacaaagaagcatagcaaggatgtgtgcacacagaagtccaggaaaaattccgtcagataaggcccttatctaccacttggcttctcggaaattttcttctggttcctgcagtagtttttcagatttaagtatatccttcctctgaacttttagggcatgcttcttttccttctgtggcaagattttcaagtcaatatgtgtgttgttctaaagtgaaatcatcgtctggccctctgattccacgagtcaactcaacaaatgtcccagtgggccccaacaggtggtgtctctggttgggctcactggaagcagactttgacacatggagatttatcaagtgctttcaggagaaaggatataaaggacagagtgagaaaaggggctaagaaaggatgagatcacaactggagtcaagctccagcctggtcccacaaggagtcatggagcatgaagtgtaccccagagtggatggtaccttgtggttgaactactgtgtccatcagtcattggtcagggctcacgaggcagagagaggaggaaacttcttacttgacggagggcagctctctgggaaaaggaagctgtgaggctttagcagccgacatgcccagtgctctagggttgagggcacttgcctgcaaaggggatctgtccaggacactaaaagcatgcattccacttggcactttcctgtctctgccttctcctacagtaaattatacgttgggtttcctgaaatccaatgagctactgccttgagattttctggcagtctgtttctaaatctgctttttttttttttttttttttttttttacacatggggctgggaactgacctcagtagcacactggcaataccaggtgtgagcatagctgtaattaagcactgcttcctatgaaatgtcactccatctcacataaataaatcactccgtagctgagcttgataaacattttgttcaacttaacaagatttatctgagcgtttatcaagtaaaagtcacatcaactaacagttttgaaggctgactttgtgccagccactgtgttaatggcttacataatagactgttcacttgatcctcttaaagtccctgtcaaagttcttctcaaagagtggtccctgaatctacagcatcggcctcatctgggaacttgttagaaatgtaaatttgtaagataattctagggctgatatccacttggagatgttgtttactggggttgatagtctgaggtttttcccctttctccattctattattaatcatgctgaagatgtactcattattttacaaaacagaaaatgaaagagtgtggaaggtataatttctgcccagaggaatttataggctggattaagattgtaaaaacagtagaaagagtaaaacataaacactaagtcgagcattgaaatagtatacttcatggaggaaaacaggtctggcatggagacagaaatgctcttagaaaaatctagagctatggttctcgaaccatggtccccagacaggctgcactaacatcccctgggaaattgttaaaaatgtgaattctcaggccaggcacggtggctgacgcctgtaatcccagcactttgggaggcccaggcaggtggaccacctgaggtagggagttcaagaccagcctgaccaacatggagaaaccccatctctactaaaaatacaaaattagccgggcatggtggcgcatgcctgtaatcccagctgctcgggaggccgaggaaggagaatcgcttcaacccgggaggcggaggttgaggtgagccaagatcgtgccactgcactccagcctgggcaataagagagaaattccatctcaaaaaaaaaaaaataaaacaaataaaaaagtgaaatatctagcgccatctaataaattcccagacctaatgaatcaggaactttgggaatggggccaggccatttttgttttaacaaaccttcctggggattccaatgtctgataaagtgtgagataagtcctactagtaattcctatttaatgaataaggaaactgaggcagagagcggtcaagcaatatggcttttagtagtacttctcagactacagcatacaaaccacctggggatcttgttaaaaatgcacatcttgattcagaaggcctgtgatggggattggaattcttcaggtcttgctgatgctgctggtccatgaaccttactaggaggaacaaaacctgatatcactttgctgaggggctgagttaggattggacccaggtgatctgataccagacactgagacattaatcacatcacccatctgccacctagtactaaacagtacacagctacacttagcaactctgtgaaaggagggtagagagtgcagtgttccagaaacttactttgtttgttcaaagaatatctaatgataacttgcagaaaatgactgcttcacagaaaacagttttggaaatgctgtgatagaagcccagatgcctagcattctggaaatcttggaagaccttaggtcagaaatatatatgtaagaaggaacagagtatcttcctatattcttggccatcagattcttttaatatattattaagttatggcatacctggtatactattaggttggggtgaggtttccttatccccactctttcagactagaacagtagttcctaaattttaatgtgcatcagaatcacctagagggtaatttaggaggtctggggtgaggctggataattagcatttctaattggttccctggtgatgctaaattctgctgactttaccctgggtctcaaggacttaaaagctgatgtcctcttaagtcccttaatggaaagcaaggggccaaataataccacagaacacatgaatggaaaaattccttaaatctaagaccatgtcctgaggatgagcaactggtcactgcaccaacagtgcccagctaagaggcgggagttgtggcccccaaacccaacccatactctattggcagagccaggagttctgactacagccatgagtccttactgagcccccttggagggaggtcacttttgtgctttgcccaagggctctatctgcatatcaagctacatatctatggagctgcatctgcccagaaggtgaaccccttttcttccaattcatccgtacaggagggatacatgttctaaattgaagaaaggcattttacagcctaatcggtggttctgcttaatcccattttatgtttatgtttctctgattatgttgcctttgaaatctctctttttctttcccctttttcaactgcttgccttgctctttaaaaacaactcaaattccaacttcccttggcttactttgttttatgtggataagtcggcttggtttgagagcacacactcattggaagaacaggagctgtaatagctacactttaatgttctgtccccagcacaagtgcatccttccacccccaggcaagacccctctattttcaggaaccacctaaagaggaaggcaagagttgcacctgatgccacagagagtgctgttttcctaccgtctgattatctatcaaggtttctgtaatggccttgccattttgcaattccccatccactctcctttagtgtcatgacattatttccttcacaaagaggtaagacaagactacaaaaatggctgtcattatttcagaaagagcaggaagccttgaaattgacttgtaattggcagaagtggaaacagtactgtctttaataaaaggaaaccatttctggttttgcacaacagatactatgcctggtttacagaagatattctaatgcaggatcctggaagccttcagtgtgttggtttgaacttcttggcatcaaaataataaaaaaaaatgataaagataaaaatataaaaataaaacaaaataaaattaggcccagcatttccagctgtcatttgttccaactgctccaggaatttcctggccagaaaatatttaggtgaaattcccacaattcacttgtaatgcgtattcttttcacttctagtcaccctgctgccacggcatgacatttagaaacttgctaaaatctagcccattgattctcttaagatcacatttgtacctttttggcagtctctaaagaatagcttttgattattctttattaaaagtcagaagaaatagaagtagacataaatcatttttgattagctgtgctgaaacccttccaagagccctctatgtacgtggctgactgctcattttgggttgatttctgggtttagaactcctgcaaagagtcaggagggacctggcataagtcccacagggcttggtgggggacaaaggaaactaatgagaacatgaaacttaatgctgcttgctgtgtggtgaataacaaagttctttgtctctgacccagaagtttcatgtcttctgccagcatctatgaaactgtggcagtctaccttgtgagcctccaaataaggtaaaatcttaggcctttcatagttattgatagacagtttcaagtgggcagtaagatttttgtggagggagcagtcagtatcatcaaatctgaaaagagaagtataaggcctgcgatgcaccctttggctatagcaatgaggaaagcactggggacatttacaagggccactccttggaagaggtggcactgaagaaagcctcattccaagtgtagacgtcccatttaaagaatgtggctaggaaggggataagagaattaagaaggcaactagggggtggggaggcaattcaaaaataattccaagggcattttatttcattgatctcatgtagatttgagaaattaaaatatacttaagtatctggttcagcggccaataaatttagaagtgtataaatatatgctaaataaagaaatctgtttttaaatagaaagcctcctgtatagaaggaaaggctggagtgtaacccaaggtgacagggccatgaggtaggcatggaagaatgagcccaggactgagagacaggacctatgtttcttcacaccatgcttctgctgctcactgcctgtgtaattccgaggatgtcatctacccatctaaggctcagtctcctcacctataaacagggctacaatcacatctaactgaaagactggttatgagaattaaatacatcctatgtgtaagcacttagtaaacatcagctgttaaacatagtatcattacattatcatcattgcttagttgcagcgtgaccactagattgtcaacagaaatgccacacagaagggatgcctggttcagatgcaggcaggtaggtaggaggaggagctggtccccagaacactcacagcctcagaggccagcagcagccctgcaggagcaaggaaacaggtttactgggcgaaccggctgcagtaaagactgatatgcctcctcagctcatcaaccctgttgcagctgctggagtgcaggcaggaaccttttcctatgagattcagatctgctcccagtccagtgaatgcaatttgtctgaaaacatacactgtccctacagagatctgcacagggcgtttggacacatggcttcatttctgagactcttcaaatgttatttgtcataaaaacccctcgtggattgaatcctttgtagggaggcctgagagtcagctccatggtggggctgacagactctgctctggagtccctgagtaattcaaggaaagagccccatccaccatgctccttgataaagacaggaggacacacataaaatatttctaaacatgcttctggatgagtagtgtctgatggtgatgatgggggtgtgggaaaaacctgtgtcctcactgttggaattagctatgccaaacccagcaaaggcttcttcgtatactaggagtattctgtaactgggaaaaagtgaccatttttctttttttaatagcattttgtttatgttagtttcctgtattcatcttagaatatttggataaaacagaaaagaatagcgatgaaaataaaaagcttcataatctattattacaatcaagtgtcttaatatgtatttcatggagttataggagtgtctatgtatatacatatgtatatacagattatatatatttatatattatgtacatgagcatgtatatgtgtatatattttttcataaagcttaatattatatgactctataactcatccttttcacttacatgttatgaaaatgttaaatatacttctaaaatctgatatttaatgataccattccctcatttacttaatcagtctcttttgctgaaaatttaggttctttccagccttttgtcctactgaacacaattgcagatacatttttgtccccatctctagatatttccttaggtaaatttccataagtaaatttactcattggaaaaatatgcatatttaaggctttggatatcaactgcctaattatcttgcagaaaagatgtacacatttatatttgctctgtgctacacttataattatgttggtatagccccacctagttgtatcctgaatgtcattttttaaatggactccacaaaactgtagaccactttgtttagtggctattccccttggaatgcacaccatctccttgcttgaaaaattgcttgcaaagttacatgtctggattcctcaggccaaagtatcacataaggaataagcaagttatgactgagccccttccaccacagaccacggcatcatacacttcacctcaaggagaaatgatcccaggacaagaagaacctgcttataattttttactagccttctatcatccttttccctgattcactacaattgttctaggctcatgtgtttgcatttctgcatcggtcctgtccattgactctcatgtagaacttgtactgtaattccacaaaagccagcaccggcagatgggatcttctaaagacatataaagtttccagaggggtgcaaaacaggggcattggctggtcctccttttaacttattaatttatgatccaaaaccacttaaggaaaagcaagctataaagtcccactctacagaaaagagggccagcatttcaccacacaggcaacagggatttatctcaaactatgaatccactggctcctttctaaccactgccagaaagaagggccaccgacatacctgctatgctggaaacaacatctttatttccctgaattacaactggccgagttgagaagttaccactttcagtgacttagtgaaattcctcagcatatctcagaagctacagcaggaagtagcactgctacacagtagacctgctgtagctgtcttatagagactcttttggccatgatgggcctgtttcatttgctttggaaattctcaggctaagtcaccccaaccttattatatgaggcagaacaacagcgagagtgccagccactcctctactgcttggacacatctgaagaaacatctcaggagaaactggccactgccttggcctgtcttggatggtggctgcgatcctctctggggtggcaggtgtgttgataggtgccttctttttgtagaaagatgttaacctatgtgatggttaattttatgagtcaacttgactgtaacagagtacccaaattaaacagtatgtctgggtgtgtctgtgagggtgtctggatgagatgagcatttgaatcagtggactcagtaaagtgcatggccctccccagcgtgaatgggcaccatccaatctttggaagaatagaacagaaaagcaggggaagaagagtttgcccctttgcctcctccctgactgcttgagttggaacagtggtcttctcctgaacttggactagaattacaccactgccattcctggatctccagctcgcagatggcagatcatgagacttctcagtttccacagtcacatgagccaattcctgtactaagtcctttccttccatataggaaggacatattatatatggaaggaaaagacttactatggatggaagtgtttacatctataaggaaacacttattaaaaaaactatatatacacaaatatatattaatatatacttacatataaatattttccttaatatatttaataaatttttataatatatattttataaaatatatattttctttaatgagtgctatataaagattatatatttatatatacatatattttaaacataaatatattacatataattatatatttttatatattatatatgttatataacatataataacataatttgttatatgtataacatataattatacataacttaggataacatataattacatataattatgttacatgatatatattataacatactatatattatatatgaaaatatataaaattatacacacacacacacacacacacacacacacacacacacacacacacactgcttctctggagaaccctgactaatacagcctacttccaattacctgattgcacataagcctggatttaactagccacacaggcatttgtcagatggcacgatataaactgtgtacctcccaatattttctgaaatgcagatgagacagacaatatttagggaagtttccttgaaaaaatagttactgaatctattcacttaccagatacgtttcaagtgccccaggatggagacagattggcagagagcaggggactctgccatagcctcttgcccacttcacccctctctcccccttctcctccccagactgctttctcacagccatcatgatgtgaaacaggcctgtgaaactcacttgtgtgccctcagtaagactgtggtggggaacattgttcattgcatcatacagtgttttcttcacagggactcctgggaacaattcctgtctggcttctgtgtgaacaacaggtagaattttcctgagcaattggtttttgtttatctcacagacattgtgaactgtgtatctgacaagtttcctttattccactagtggctacaaagctgcgggctctgtgtgtgacccaccagttagtaacgtgtgcagaaatgcggttttcgcattattaccagctctgtgtattttctccttctatctggtgttgtcccacttttaatttatgatatcttgtcatgttttatgtcccattgaaagccacctggaagacgttttgtgaaataagatttggtttacattgaaaaggagataagatgtggaagagctccatgtcatgtgtttccatctgttttcttcaaatattcagttatgatctctttaacatcctcccactgacaaacccaaggttcagggcatgcaactaagaactgccacaataacgatcataaaataattggaaaacccaaacaaagttgctgaaaatattgtgatggtcctgcctcattctcatgacccagctgaggcaatgccattgaaatcacacagcttcttggcagcctaatacacttgaacactaatcgtaatgaaaagagtaaataactctaccgaatactgaggtgacgtggaggtttcttatgctctcctgtggtctgtaagcaaccctgggaagcagaaagaacaggtatttcacgctgctgtgctgctatttgcactctgcttgctgctaagtggcaaggaagaactgttggtccctagatgggctctttatgcccaaggatttttctaaccacaggaaatggcttaaattcaagaaaagaagtgacaacatgaacttccaagaaagtgtgtggagagacagctaggcaaaggaacacatgaaaatatgttcagtatcatcagtcctctaagaaatgtaaattaaaactataacgtgctcccattacacacctattgaaatgctaaaattaaaaagactgaccatactgagtgctggtgaggatatggagcaactagaactttcatagactgctggtaggaatgtaaaatggtacaaccattttttcaaacagctcgttgttctttaaagttaaacatatatctaccagatgaccctgccattccacttctaattcactttcatacccaagagaaatgaaagaatacgtctctacgaagactcacacatgcaggctcccagcaacttctttgtaatagccagaaactgccaacaacccaacaggtatccatcaacaggtagatggataaacaaatagtagtatatccattctatgaaatatttcttagcaaaagtaagaaatactgttacacacaacaacataagtaatccttagaataattctgtaggaaagaagggtacataccgcatgcttccatttatataaaattctagaacatataagctaatacatactgtcagaaagcagattggcggttgcttgtgacaaacgggagtggggaagtcagaaggaagtgattacacatggggacggaactttggacgccatgcaaatattcaatatcttgattgtggtaatagtttcacatgtaaacatacaaaacttatcaaattatatactttaaacatcacatctcaattatacctcaataaagctagttagaaataattttttgagaaggagtttcaatctggttgcccaggctggagggcagtggtgcgatctcagttcactgcaacctccgcctcctgggttcaagtgattctcctgcctcagcctcccaagtagctgggattacaggcactcgccaccacgcccagctaatttttctatagaaataattattttcatgtcaaatcaccacagccacatgtagttagtggttcctgcactgaacagcatggctccaacttctgtgctgccccaaaaacttgctatttgtgctagtattaatggaagtatgctaatgttataacaagttacgttttagttctatgtgtcgccctctgtcctaacccccactcaaagagatcctttctcatctttcttggaaagtgggatgaacaagcagaaataacaggaaggcaaattcaagcttcaaacacttccctgatggactttactaacggacttatttaaccaaagaatagacagattgctcattttagtgaaaaattcccataaaaagcgactctctaattttacccagaagtaccagtgaatcactggatatccaagaaccttccagttaagattacatgacaaccacgtaccaagaacctaagctattccatttgcctcagccctagtaatctgcaattaaaagacaaagtttgttagagggtagttggaaaaggtcatagttacaaattctagttctggaacttttaggttttggtctgggtttctgcatgtataaaatggttataccaatgcctgactagcagaatcgtagttaagatttaacaagatcatagatgcagggcaccatcagaggaacagaagtactttaaaaatctcccttccctgtacacaccaaaccattcatcatagcacacactttcttcccttatcaagggataagacagcatcgttagcccaagctgccccatttcgtaaactcacaccattttgcaaatgctggttagagcagaaaattccgcaggggtttgggccatgagacacatcccgccagacaagtcccaggcctaaccatctgaccccaggaaactcctcacttaccagcgactgaccacaccacccaccccatctcacaagcccagacctctcccgcctggacctataattaccccagtttgtaagcaagggtgggctccggtgctagctgttgtccccctctgcatgtctttgttcaatacacttgtgttgccatagagctgcttccttccagtccttcttttccctttctcatcctaacgagtctgagcagaggcttctctcatgcttacctggagccaaagcttgtcatgctgagaccacttcccaccagcaatgcactgaaatgtggcattctgccccacattcacctccacgttttggagtcgcagaaaatgaggtgcttttcctaagagagaaaccaaagaacacaagagaatgagattcgacagcctgcaccacttccctattggtggatggcagctcaggatgggcactgggcagggtggaactggcacttaagaagtagcccggctcagtcaagatttcattgatcacttattataagtctggcactgttcgaactttacacgcagaatctcactgaaacctcacagaaatccatgaagtgggcagtatccccatttcacagatcagaaaattaaggctctgagggtttacgtcatcatttggcacagacacatatccagagggggagggaaccaggacgtgaatttagatctgtgctctgtgaaattggcacaaacatgcctagaatacacccaaactgatcattgcttctggggttggcattgcacaaaaggtgaaactacgacactgaaagttaaaagaaaaattggggggcaggaggggtgtattcaccataggtgatgcttccctgtagcctgaagaagcaaaataagaaagctgaagtgaagcacctttgggcctgatacctgcacacttggcctgggtgacgatgttgatgaggaagatgatgaggaagacaaagagcggaagagggaggaaaagggaaggaaagcactagtagctgtcattcttagcgcttgccatttgataagtaccacatgcagtgtctctctgcagtaactcacttaacccaatgcagtcagtagtgttattttctctattacacagtgaatgaactgaggcacagagaactctagaaacgtgcccaatatcacaagaccccagagtcttactctgtgatggtgctttctgagcatgagggggagcgttgattctagggactggacataacagggaaagggtctttcaaatgaaaatcagggtgtgtatgagcagacaatcttcggattaagtctatgttttatattgggtaacctggtttcatctctttccttttttgtggagaagggtcctcacctacctgcactctacaaataataacaacagtaacagctctccattggctgataaattgtatctagaagaattggtttcttcattgaggcacaatgaaggatctctatgccatcaatcaaatcagtgatgaactgggatcacccccagaatggaaacaaatggagggttaggagaggatcaaggaggtttaacaggaggctttggccatctttctacaaggagtcaaatacacagagagacaaatagtaacaataatgtcatttactgagagctcctacaatgccaggtactatgataaatgctttgcatgctctatctaatttaacttcatgacattcctataaagcagacactattatgatttccctgttaggcagaaatcaaggctcagcaagtttaatgtgctgaaagctacacagcgctagtgaaagacagaaacaaaattcaatccaggtccactttagccccaaactcagcatgtaacaagcagctatgctcccttgcctcctgggcactgggaatgaggatggtgtctccagatagactccagggtctgcagaaggggctcccagtcagggctgtgctgatggttcaggtttctgtccatgctcccaaatattttattaaaagtgacccctttccatgctatttttccttgatttgaactattttgtctaccaatctgtgtcagcacctataaagctcagcaaaagccaagaatcttggaacaattaggcagacttgttgggagagcactgggcagcgtggaattggtgcttgagaagtggcctggcacagtgaagagttcattgatcgcttatgatgagtctgacactgtttgtaggactttacacgtcatatctcactgaaacccccaaaaaatccaggaagtgggcagtatccccatttccccaatgtacttttactcaggtttttaaactaatgacagcagctcagagacccctcaggctacctttgagccaccatggctggtgtggtgtcaaggacccaaggcccggggaaaaccacctctatgggcttttcagagttgaaaattcctgcatctagtcaacttgacaaatgccatgctgctctgattgtctgaaattgtttccttttggctctcctgtataattttatgaagttatttttggaactatcagttcaaatcaattcttaaaatgggaatagagtgaaccttggaagcctgttcatgccacaggcttaaagggggagtgaacacatccaccccaggtggggagggagtgcagagtcttagctccaatgctgggaaactctgtgtttagttttacaaagaaatgctcttcccttacccttcgagaaaatggtttaacctctgggatatgcacaattagcaatgaatcttttctggatcaatgtccccagcatgcctctgactcctctccacttcttccttctcagcaacagaccttttgccttgattctttcatcttcaattcctcttcttcccttccttctaggttcagtggtagagagtttagatgtttaatggctcctagtgtgaatattctggggaaatactggcaatttacagcagagataatgaacgcatgcacctacaagagccagttatgtaaattaataaagtcgttcagctgtaaaacaaaacaaaaataccacctccttgccccatcttttactttcccacttttgatagagacttgagaaaaataaagatttctttatataagaaaagcaatgttgtaagcacaataactggtatccaccagtagcctcagcactgaggagacaataaggagtggtgaggactggagggaactggagagagactctgaaaggggacactgaaagggggcagctcctacttaaattcagcagaggaaggccaggcatgcatgctttgtataggggtgtcaaacgtctgatttctccaggccagtaagaaatccagactttatatgaaatctctcactctaaactcaacatgttattaaaacacagtacaggcttaacaaaacatgtgtacatgcaggctctatcaatctgcggtccctgatatgtagctcttatgaaagtcctctgcaacaatttccactagccagtctcacccgatccagccccatacattcagggatgcccccaccactccatgcggtacgcggtgggcatcacatgaaggccaaccccgagtacagttcccagcacaggagctgatctaggctaccctcttcttgctcaagacccttgtctctgctccttggggctctgggtcatccttggctcatgacaggcagtgctctctggtgattgtgcttatgtggggggcctgtatggtcctcttccctgcgttcctggcctctctgaccctcctttttccatgcccccaaacggcctgctcatcagccgcaagctctctcaactgtcaccttcccccagcatctgctgctctgggagagaacttatattccacgagcttcaaatcactcatcttcagccaaacatggttgaccttggtacccaggtcagccatcggctcgtggttctaagcatttcctactcactccacactgagacccaattccccccagatgggatgccactgaatgggcttaacagaagactggctgtgcatttggggcaaaaatgccttgacgttagtgacatttagacgcctacagatgtcagtgcagcatctgaagacatattattgtgccctttatcttgctctttaaacctgacagtgctcagtaggaagccacacaattgtggagaaagcccagtacgcacattagaaacatgttgcagatgctctgtgggctcggggacacggccccacaagattgtgagggagaaagaaaagtcaacttagaagctagaaactttgaaacggagtggaaaaatcatactgacatttatcttacacagttataactgccttggccctgctaatggctaacactgagaaacagcaacagagggtaactaaggatagaatacttttagaataacacaaaaatgttaaatgggctataaaatatagatgagaggcttccgtttgtaagagaaaataatttctttgagtattatgcctgtcttttggttactgttttgggagcttggaggcaattatctacagttctaatttcagtgccaatcaattgaagatacaattgcaaatcagtcactcgctccctggaacttttggaatacttagtggaatcacttattgataaactctgaccatatgttaatagaaaatatgttttagaggacagaaagggataattaaaaagactttatgtccacaggcttttttgaattgaacgcatatatttcaatatagttcaatttttaaccatctatgagtgaagtcataaattctaagactggaggctggggaaaagcacctttagtctaaaggagagttcagaagctactatccacttgcatgacaggtaatccctgtaagcagtccctggggcccacagggcccctcaccaggcagcctgctcagttcttcccaggctctcaccaccttgcttaagctacaaatctgtgagtgcactatctccgatgcctgactcttaatccaatttatcaaatgagaccagttggctctgcctcctaaatggatcgctaatctctgcacctctatccacctctatgctctaagtttcttcattgtcctgctcataatttgtcatggtctgaactgtgtctcccccagatttatcttttgatatatgaccccaacccccagtatctcaaatgttcctatttttagcagcagggcctttaaagacatgattaaattaaaatgaggcctttagggaaagccctaatccaatccaatctgaccagtattctcaacagaggaggacatttgaatgcaccgggagacaccaaaggattgtaagtacagaggaatgaccatgtgaagcctcagcaagaaggcagccacctgcaagcaaagaaagagcctcaggagaaactacggtggccaacaccttgaccttgaactgccagcctccagaactgtgagaaaataaaatacatttaagttgcttaagccatccagtctgaggggttttgttatagcagctttagcaaactaacgcactgtctgtgcatataattatataatcatatcatataattatataagcatatcatataattatatatgatatgcttatataattataaatgtatatatgatatataaatgtaaattatatgattatataattatttatatactataactcacatttatataatatatacttctatataatgcttgtacaattatataatatatagattataataatataatcatataattactttatttgttttgcttcagcctccttcacttcaatagaagtccatgaagacagacagtcaatctgtctttctcactcccacaaacccagaatggtgcctgacatggagctcacgctcagtaaatacttgttggatgatgaatggatgtctctcagtcaccctggtgcgggccaccaccacctcttgcatggctccagaactttcttcctcctaggtctcccgacatcttctctatggtcctccaacacagagcagcccaagtgacccttctccagcagcactccctgcagcagagcctccctgcccttagacaaacatttaaactactcacgatgctgcccaaagtccaggctttcctgcccaacatttgccctgaccaccttctcctgtgccctgtatgctcaggacatgctggcagcatcaagccaactccgtgtgcagggcctctgcaaccactatctcctctgtctgaagcacccctccaccaaatcactagactgtgaactccctcctgtgatttgagtcccagcccaggtcacattttcaaagatatctcctctgaccactatatccaagcagccctcccgtatcccagacaccgacacttactatatccactattattttcactatctgaaatttctggttacttaatattagttactgatttagtgcctttctttccactggctcttctgctaatcaaacaccatgagtacaaggaccgaacctttcttagtcacttaagtatcactgtgcctaggaaagttcttaacacatagctgatgtacaataatttacttgctgaaagaaagaataaaaacctgggctaggtatggactgagcactggtccttaggaaagggactttgctaggccctactcaactccacatgattcgtgagctgtggatatacctcaggcattatatacattgccagtatttgtccatatagttaagtgaaattttttccaattccagccactcctatggggtcttcacatcatgctttctgggaagtttatgcttaagctgcctcaacactgaggttgaacccaacaggagcacattatgcagacataaagccaggatcacgccttcctgagttatatcccatggtccatttgctgggtaactggctttcagcaatttcatgaccatgccacccacacccctctgcaggaggaggatgaggttgtcaggagaatcctgacttcaggagcaaccccagtgaaacgagaatttcaaaaggattcatgagactttggggggtggaaagtcattccagtgccctccaaagagccctctcccatggagatttatcaaagaaaaaggatgcatttgcttgtgacagcaaaccatggtcagtgcttggaggtaaggcagagcttttaccactctggccttgaaggtagttacggctagggtaagagacaggtgtcaaggttgggcatcaggacggagatgaaaattcccattagagcacaaagttctgggatccaggtagagagactcatgctattttcccttgggaaaagccagctgtcacctactagaaagctaaagtccaagcatccagcacaaagtaagaagcaggaacacaggtagatgtggcagaggcaagcacgctctgagtggatgggatgtaggcagggaatgaggaagacagaaggcatgtttcagagagactacctcgaaactggaggtagtgcaagattgagcgcatgcaattaaatggaccacaggtagcacagacatctcccaacacagttgcccagtcttaggctcattctcaaatgagcagctgatggtgactcccacgagtccagggtggggaatatttcaccctagtgaaggagattcatatgcatatctactacataaaccctgcatagctggggggatttctgggatcctcttcacatgaagtctgggtcaatagaaacatttccccaggcatgactgaatgacagacccatctgagaaattctaaaagcctcaggaagtaacccagagggtagggactttcagccagtgcaaagaagagcccagtagcatctcagcattcccaagataccagttgcttcttgggaaagagggtctctcctgcacaggatccaaacacaatttctcaaaataatgttcggaacttgtaatgtgttccaaattcctccagagaaggggctctaagacaatgagtcagacaacggcattctagtgccaggcagagggagggaagttacatttgagggtctgacaaattcattgcagcagaagtggaaagagttatttcaattaaagcaacatggatgaggctgaaatgagaatagtccctaaatgcgaggattgagaagcacataaggagaggaggacccatgatgtctcttgaggcagcagcaaactgcaccatagcccaaagcatgactcatgcccatatgggaggagtggagagagcccacagggggttacctagaactggatggctgccaagaaactactgggaatctccaatctgcagaacactaacaaactcatggggctggcattccaggtatccctcccagggtctgccataatctccatgcaaatcagtttgatttcagtccccccaaccaaatgtcactgggtatgatgtcatctcaactacctgtacccaggacttatggcctctgagatttagtaaatccagaaaccacatctccctgctgaaacacattccaatatctgagactaaatatggcaaagaagtagatgggtatggaggagtgccacgcctttgaggactcttgacgctgtaccataagtactaaccactatgagaaatctctatgcctacatggagctgatgagtatatttaaaattattttaaaagaattaataacttcagggtacttttccctgtgagggaacagtgtgctaatttgctcagtgttttggtggtggtgtgtttttttttttttaagacaattgcacaagattctatccaaagccctctaattctaccacttcagtggtctgaatcccactaataaacaatcaggactttagactcccttaataatggagagagattcaaacaaagatgttttgccactctctgcaaattcctggaggtgctgcctgttgaacaggccggcaaaattatggatttattcaggactgattgcattgagtatgtaagcatttctgaaggattcaaagagaaagagagagtgagagatgtttgtaagctgaatgaatggaagggattgcaggctctatgctacccagtctggcatggatcaaggctgtgttgggaggaagggaaagacttactgcatggatgagcaaggacccggacctcgtccacggcgatgtagccaggatgacccttcaatgagacggattcaaatatcacctgcaacacacagggcgggagtcaatttcacagaaacagttgcaggcattcatcacaagaagctgcccggcccccagccctttatgtttcaacttcccatcagaagcaacccaagaaaccttctgttaagacagcacgctaccctggcaattgactgggattttcaacacaaggtaaaaaggccacactttggtggctagcaaaagaagaatatttttaacaaatttcagaaataacacttagatgcaggaaaaacaacccaaacaccgaggtctcggaaaccccagtctgcatctttctcattgcagcttcaagggtcaagccacaacttgaccattcttctacagagaactactttctaatattccaactttcttatgaaggataagatagatgcctaccttggaagctaccataagccaaggagggtttaccatgagttgattctacattgccaaggaacatattacatttgaatctataataacactcttaaaaataagtggcaatctacctgttggtatccaggagtagaaggcaactgacttccacctaaactgctatttccataaaaattttgtaatgcatttagcttccctcatcactcaacctctatcttcaccaaggagatatgaatgtctgtgtggatagcatggccaacatccttgaactctctggttccaatggccttcttcaatccactttagccccactttcacctcatttttcaccttctggaaattggaaattccattttcccatactccggcacagtctctaccgacagtctcatcccagttgactcctcttgacctgctcctcaggctcacgtggtagcctggacctctgcttttcttatctaatccttggattattaatgcagaaggtccaggctaccatgtgagctcctcagactccatacgagtctctcctaaagcccccattcctttgcacctttatttcaactttgcccagcctataacacatttgccttctccaatcctgtaccttacacaactgccgccctttcaacatgcacccatgtaatcccagcagacacccacatcttcaagaggcaagagggaaagaggggctgacttctaactttttacccactgacttgatatccatccacaccatcccctgcctcttctttgcaaggaacatcagcgctcttgacccggactcttgctatattttccatcttttggattctttttggttttctctgtctaccctatatctccaaaccctcccttttatccctaattttgacatgtcaacagcttctcctattctttaaaaactacccttcagcagcaggttttctctaataccatccagttgtgtttcagtaacacttaaaattctcagcagttttatcttcattgactcccaacacttcctgactttccactgcaaaactttaacctaatatgatctggaacttcccctaaaactgcttacacggaagatactaataatcttctaattgcttaatcaagtagatattttcaatctttatcttactttaagaaggaagatagtacagtgcttaaactcttgttccaagtgcctaggttcaagtcctggctgtgccacttgctagttagtagtcctggaaaagttatgttactgctctgtgcctcattttctgcatctttaattatagtgtctacctcattgagtgattttttagattaagggagttaagaccccacttagaacaatgtatggcacatggtacattctcaagaaatatttactagaattattatcacaacttgaccattcttctacaactgtcagtgttcatagactctccatttctgggtcttttttctatttaggctcagataacactttattcttgttatttttctcataaatctggcactgttcaatgcctgggaggtctgtaggcattcctccttctccatcttcccttctaacgtgggcccctgttagtcatcttttcactgcatacactctcccttcaacagctgccaatgcactgataactccaaagcccagctctgcaccctagacctttcacccacacatccgtcttaggtgtccaggtcacagatctgtatttctacctaggtaccacatcaatgacgtgaatccaacagatctgcacagattcctcctcaaaccttttccctcattgaccaatagtctattctttctgaaatacggaatatggttaagtggcactatgacccattcagtcacccaagctggagaccagggtgtctattgggcctcaacttctgcctcagccctcatcttcattttcctttttattctaccttattagcatttctcaaatcttcccatgtcatacatctctgaattgtatgctataagataaacacctaaaacagaatgactgcacaacattaaaaagaacaagttgaagaaagacataataaagaaatgcaaataaacagaaagcagttgttgcaaaaatagtgtgaaaaccttgaagtagaattttaactgaaaagaacaatgaaaaaattaggtggactaaaatggtcatttagaaaaaacacatgagtcaagggacttaagtgaagaaaatgatgaaaaagacatgggttgaagactttaatctatgtcttagactttgactactaatcgtataggaaaaagcaagtatatataatgtaaataataatgtatttcctagatacatgttaataaatgtaaagacagaatgaaacttccattcaaaggcttatggctcagttgcaaaaaaatcatatactaggctacaatataacttcaataaatccctcgaagaagaaattgtttagctttgggcctatacattttctaaccaaattcactacaactagaaattagtgacaatgtcttaaaaaccaatttatttaaagttacacaatgctttcttaataactatggtgtcaagtgtgctttgtatgttagcaaaaatctaaaacaaaattaaaagtcaaatgacaggttgagaataatatttgtaatacctatgtcagctaatatgaaaatatccttttttatgtgtaaaggactcttgagaatcaacaaaaaaaaaaacccaaatcattcaaattaaaaagtggcaaatgacttcaacaggtaattcacaaaaagaggaagtaaaaatggtaataatctatgaatgtaattgtgtaaaatgacactgagtatgatcaaaaggtgccccagaagacacctacaaccttggagggagatgatcactccatcaatatgcttctgacgtgagactcctagccataggaagccccacccaatagatagccagctccagtttttagggacagacaccacaaggggacaaggtgatgcctggaccctcagagatggaaagacctgccaaggtgttctgaggagagggagaatggttatctctgacccaagcacactctcaagaaaattcaaccacggcccttgaggaatcaaagtcaggaaatgggagagccaggggagtgagtagagaagtctagaggtgactctggtgcagtgttttcctcctgtcttcaggaggcaggggagtagggatgggatgtcttcaggaggcaggccatgcatacccagtggcactccaagtcagtaaatggaggccgagaccctgagtacagggagtggagcagagggcccaggctgagaattccaacgtctctgtagatgctcttcagctccaaggctgccatgtggacctaccatctattgcacatgctccagcccataggcttcattagagacctcctggtgcgggtgttgaagagatgaggcttgcatggaaaggtgaaaacctctccctgtgcatgactacttgtgcaaagccaggaagcaattccccacaagaggctctgagatgagtcttgctcatccttccaaaaaatggtttttgttcatacttggaggagggtgtggatatgtcaggccatggtttaacagacctggtgttttaacctaatcttttatagttcttgagcagaaaatctgcatggcaaaaatttcaaggggctgcaaacattttcaggagaagagaaaaatgttggcacatcagaactcctcttagaacataaatatacatgttttcatggggagagattgtttagggtaaaattaagagagactttttttaccctatcagcccaaggagacctgtataagacaaggaggaggatttgatgcttagtggagagaagtgggatgggtaaggaagcagatggaatagaattccaagagtggtagagtgggcccctcattgtgataaactccacttcattgtgagtgaatttactaaatctacagagtgccacatagcaccgttttccagggaaagggactgagtttaaagtccagttgaaccaaagctgggtgagtccttaatttcaggggcctatatagcgataataactaccaaataaaagataatttttcctaggcaggtgatggagactagggcaagcagatggctgcaaaattaacagaagttcttttatttttttaaatcttgaaacagaaaattcagaatcattagaaaatatgaaatcaaattaacatcacctagaaaggagctgtgatctgaagtacacgtgacttaacagtcattcagcactgagtggtgaccacatttaataataatatattgtgcatttcaaaattgctgaaagaatagatttttttaatgttctcactatacaaaaaaagttaagttggtgaggtgatggatatgttcattagtttgactaagtctttctataacacatgcatagatcaaaatatcacactacaccctctaaatacacacaattaatatttgtcaattaaaagtaaataaacaaacaagcccctgctttcccaagaaaaggcacatgtcgggagatggctggcagaggcaggttctcacccccggccttgccaaaagtctggtgccagaaagctcactaatgagaaagaggaaatttcagtgtttattacagagctaaaagtcaattttagaactataaaatacgactttaataaattaatacataaaccatcagctccgaagcccagtaatttgtatttagcccatagaatcatatgtacaggaccagagctccaggtctggtgaattttaaaacccattttgctagtgtcattggattttctgataggcctccttttcttgccactgtacttatgtgtatatgtgcaagtatgttttgaatctgagagtcttgtgggtgcttgtccctatgtgggcactctgcagtgtttgtggccaagtgagtaaccattagtgacggtgtgtgtataacatctctctccaaactgctgctctcagccaaggaaatgcaatgaggctgtagtagccaataaggtgcaaatcagaaaattctcccagatgaggctacttatccaagggagggcatggaggttactgagtacaggcttaacaacactggctatttcttttaaaaaggcttccttcctccttcccctttgtctctttttccctcttttcctttttccctccctcccttcctcccttccttccactgaggcccactacaagcctgatggcatggtttggctctgtgtccccacccaaatcacatcttgaattgtaatccccataatccctacatgttgagagacgaacgtggtgggaggtgattggatcatgggggtggttttccccatactgttcttgtgatactgaatgagttatcacaagatctgatggttttataagtgtttgacagttcctccttcacaggctctctcttgccttccaccatgtaagatgtgcctgcttccctttctgccatgattgtaagtttcctgaggcctccccagccatgtggaagtgtgagtcaattaaacctcttttctttataaattacccagtcttgggaagttctttatagcagtatgagaacagactaatatacctgacatgatgatacatatatgttctctaatttcatctgcagaaggtcctatcatacctaatatcctctccattctacagatgagggaactgtgattctgaatgatgacaggatacagctaacattacacaactaggaagaagattctcagaaagtgcaagctattttccctaaaggcaaagcagagcttagagccagaggacctgggatggatcatggggacttgaatttaccagtagtgcttcctacgctggaagataggacatgttgccacctaatagagggagctactgcacagatctcatgcctctcatagggtgtgaacatagggggtactccagaaatgtcctttccccccatgcctcatccaaaagcatggcaaatggtatgactgtccctgtactcagtcaattttcttgttcattgtacttcaacctgtggccccatcctgtacccatttgtgtctggtcctatatatggggtttctaattgaaaccttaaaggctcactgaccgtgcccatgagcttttagagatactttatgtctacagtcaatgatacagtggtgacagtctagggagtagggtatctgggatctgctctcagctttgccaataatttgttacgtgttcttggacttcactatgcaactctggacatcatcagctttatcatgtacatcagggttcagctatggcctggaagccaaatccagcccaccacctgtttttgcacataaagttttgttggaacacagctgggtccattcatttacatattatctatgactgctttcatggtacaatggcagaattgagtaattgcaatagaaattgtatggcttgtaaagacaaaaatgttttctttctgcccttaacagaaaatgtttgccttatctacaaaatgaggataaacctaagccacatgtgccagtatgcattctgtaaatgtctatggataggaagactatataatttatcactgaaactggggcacactatgaaatggatgctcttaatttcaccaggataatgggagtaaaccagggttgtcccagcaaactgagatgtagggccacctgtctgcagaatactatctctatagtcaggtggtcatccaacaaaaagagggccaagatcaaacttagaggcaagacaggaggttaaacaccaataaatggatttctttctgactcctcagaactcccacgtgggtaactgtgagtctcctagaaccgaatacatcacacagctttttcaaaatgctgtgacctccaccacatcagccttcactacagagaatctcggggaacacatgttccacagagcacactctacaaatcatacactgggtattcttcccagaatgtacaagcaagatctgatccccttgttcacgcaactgtgcaggtagagaatataaggctatatgcttaatgcaattctgaaaccccaaaagctctgaaaacaacgttcttcaccttagtattataaaaagtaatttggtggtaaaacctgaacacagccgaatggcctgatactacttacagtctttatttatcccatttcttgtgagtgtgtgtaagttttgctgtagaaatattacatttgattacagggtactgcctcagagcctaccagggttgttataaaatacagaagatatgccaatatattactaatatattactaaattccaaacattgtgaattctgacacatatctgacaccatcagtttcagataaaggtttgtactaaaacatattacacaaaaggaaaagacaccgaagtaaagaggccaaagatatataatttgtctcaaaacatctaggatacaacacgtcacgttgttagtgacacgtgttaaaaacaaaggactctgcttttagccactttcattcataggttcctgctgttgtaaagaagggaacaggggcttaacctcacaccaaatgacaacagtccaccctgaccaccccaaggccagctctgtcccactcacctctgcgttaccaatgcctgaactggcctggctcacgcaggatgcaaaatgactgacaagcagatgagaatagggagcgagtggctgaatgatggtgtgatgagttcttccaagaatttactctctctttttctcttttcttctctttctcacttcctcttttatttctgctctcttcctaactttccttacttcctgcctctggctcttggtcacccatgggcaggccaaggagatgaggctgggggaaaagcaaaggaaacgtggtcccaaacaaggctacttaggtccatctcccaggctgcttgcagatctccaggattgcgggagtcacctgtgctgttcgacagtcattgccattatatctcattatttactcctttaagtctcctgacaaagaaccccaaaataaaaaccttaagaaaaccctcaacacagaccaaggcattacaagagatagctgcgggattctccagcaatggaggatgagaatgagcagaaccagcacctcataaaggccaggtcccttctgagagcccagccttggagttaccccgcttcatctccccatccacaagttccaggcgtggctaagcctttcaagaactctactaggggaaattgtggagccaagtggttaagaattatgatctgtactaatttgacaaccacgagctactgaagcgtggctaatgagactaggaaactgaacttctcattttacttaacttcagttaccttacattttaatttaaaaactgatacccaattcacttaagaatgtttggaacaacttgtgtatatgtatccacttcttcagctatacattttatgagtccaaatacagatcattattactaatgaaaataaaacatttaaattgagacttactgtaagtgtaaaatatagactgaattataaagattgacagggagagaacagaaaacatctcactaataattgtttagattgattacatgtccaagtgatagtattttggatacgttggtttaagtaaaatgtattactaaaattaatttcactgatttccttttactttttaatgtggctactaaacgtttataaatgacatgtgtggttcccattatatttatactggattatactagcttagacagtgaaatcaaacaaaacgggtaaaaaacaaggcactacctccgttcaagcttgggttatcacttaccatttctgagccttcgtttcatcacctataaaatgggtacgtagtacctgcctcaaaggattgttgtgaagattaaacaaggtaatgtatgtgaaacattttgtactgtgcctggaacatgataaacacccaatgaacggtaggtatcaccatcaccaccattaccatcatcatcactacctctcccctatttctgaaaggagtttcaggaaatgcatcatgaagaaaaataacattattctaaaaggaaatcacaagccattgaggataaaattgaaatatgtatggcaaaaatccagtctaaatattgagggtaattgagtattaaattctgatttctcgttaccaaggcaaaagggaaataaagcttgaattgcctcattaaggtaaacccaacaagcaatctcaatagatacatgtattcctaacactaaaatctggaagaactgtaccatggatattaacttggagaatgtctaagaagcccccagccaccggttcatcttctgcttcagatgctagagaaatttctccaaaatgcagatctgactgcctcaccctctaacctaaaacctttcaacagtgcaagtggagattaactgcaaatgagcacagtgtatcttactaggatgatgaacatgttctggactgctttataatgatggttgcacaattcaataggttttcttaagtcatgggattgcacacttaaaataggtggattctgtgatatgtacattttaccttaataacattgttaaaaaaaaaaaaaacaaaactttcaatggccccaggccaagacaatgtggagaaatgttcctctaagcatgctttatggattggtgccaatctgtgcgctgtgtgcatcagttcgcaaggagataaggaaggaaagagagagaggtttaggaactgttgcaacaatctgtcattgccatgattttttttttttaccatggtttataagagtattgctccacaatgagttgagaggaagtgtcccttcaccatggacagtatgagcagcactgctttaaactaagttccatccattagcctgacattcaaagccccccatgatctgcttgtccctgcaggctgatctccctgtctgtcctctttgcaatgtaccttaaacaacttagactttccaaactctgccatagtctatcatccacccctgcagctcactgtacacactgtctgtgacaactcaaatgcctttccctccctcccttttaaaataaatttgtattcattcttcaagattcatcttagatgtcatctcctcttacaaaccatcctaattgccttccccagcaaacaccccattccccagagggtgatcttttacgagttatttcatctctccgaacctcaatcttttcatccataaaataggctagtactagtacctccctcatcatgtcataagcactgactttataaaaaggaatcaatgcctatgttcctctagcatcttcaggagccacatgcatcctggtacattgttattttatctacatatcagtcttttcctacaaatgatgaattcaagtgggacagcggctgtgttaggtcacctctgcagagcttggctaggaggagaagcacagtaaacacgagtgaataaatgaagtcctttctagacctagcacctgtagggagagcaaaggtgtatagatttattacaaattttcaaaaataaaaccatggtaaaatgccatacctgatagaaatgtggccagaaagtgctgatggcgagctctgccttcacccagccctcagtgacgaccccggacacattccacacagggttcccttgggggccaccattcaccttcacgtagacgttcaaggcccctgggctggacctgtcacggctggagaagtagtaatggaagtcgatgcagtgggtgtcattctccttcagggttggcaggagaaggtgggccttctggccagaggctctcccagagctgttcaccatcatgaaagatcctggagacccacaaagcaggtgggaagtagagacaaagagaaagtaagaaaatccttctgaaaatcagtcacacccataaacatggtggccagaggagtggccagagatcaagtcactctagaagggtctgggtgaccctgcaaaagccacatctctctgagcctgagtatcctcttctgtaattgggtataaaaaatctattcaataaggtggttttaagaattaagagatggtaacatgtatgaagtatttctacaacgtgctactattgctatttgcagaaaacatagctactattactgtttgcagaaaacatctccaagcattcaaaaagtttccttgtaggacgaagtgagcctcttttgagttgctttgacaaattaaatggttgtttccaattctttatccctccctggatccatgtcccttgccactggctttgcagttccttccagcagaaacagagggtatgtccccatcccttgactttgggctccaccatatgacttgttttggtcaataggatgctaacagaatgattcaagcaaaggttaaaatgtgcttgccttgctgggcttgccgtcttgcactactgctacctttcatgaaaaggatgtgcccccagtagctgctgcccctttcagcttgggatcaagaatacacacatggaggacacctgacttgaactgatcttaaagaaccaagccatgccacccctgcagctggaatcacagccacatggcccaaaagcccaacctagatcagccaatctacaatcaatgcacagttccatgagagctagaataaacgcttattgttgtttgccagtgagtttcttttcagtgtgtcatgcagctttattgtgacaatagcttattgataaagctgcctgggagggcagactcatgaaagaaaccatgagggggtaaatttcagttcagtgtacaaataactttctaacaagtaaagttggtgcaaaatagaatggactggccagagacaaagtgagtccccaccaaagcaggtggcaaaacagagcctagacaaattaaagagatgattaaggaaatttcacaagcaactgggagggctgaacttagagtcttatgattctatgaaataaactgcatcatggaacactgcagataaactcagttgattctagaaggacagtttccacctagaaaaccactaaaatcttcaattcaaaaataaaccttaagaccacttatcctcagccaagttgagctacttcaatagctaaaagtcacctcattctttcaccctaataccaaaaagactaacagctcccagttaataagtgctgggaaacccataacttcttgggattctagaaggtaccaatcaaaccctgtctccttcaggttctgagtgaatttaaaaacagacatgagagagatagaaagggagagacagagagagaggagttcaaaacctccacgttattattcacaaagtaacttggacttacggccaaattagactttctgcatgtttcccctgaaccaccatgcagagcaggcggatggccatggacccaccctccaactgtgcccagatccctagggccacagttgtcttactgggatgaccacttaggatagttgggtgggtttgtaccaaaaggtagccaggtgaaaagcacagagaaacctgaaccagtggctatcaggttttcgccatcctaccaatgagaaaaacttgtgtgtaaatataagggatacaagtgcagctgtgtttcatggatatgttgcatagtggcagagtccgggcttttagtttgactagcaaccaaatgatgtatattgtatccattaagtaatttctcatctctcacccccatcccaccctccaactcttccaagcctccagtgaatatcatttcacactctgcgtccatgtgtacgcattatttagctaccacttataagtgagaacatgccgtattgattttctgttttggagttacttcacttaagattattgtctctagttccatccatattgccgcaaaagtcatgatttcggaaaatgtagcacctcctggggaaggagccactggaagtggaacaaaggtgcgggtgtctttgcctggtgtttctgagtaaggcgtcccagttttatggccgtgcagtaacacaaggtaagtggagcaatgtctctatgtcagagaagttattgaattatcataaactcgcaagggggcagctaaaaaggagcaattataggggcagaaattgaggcttagagatgagaccgagcctgcatccatgcccatatctgtccactggcctacatgccacagggttccaaaaggtttccttggacaggtaagtagcaactcacaagccccacaaagggtttgtgactgcctctgccactgaggagtagcacatctcccagcagaggcagcagcctgagaagcaaagtgtctctctcctctctgaatcccatgatacccgcatgcacatttcagctcctgtcctcctgccaattcacgccacgggctcatgtacccttggctccttacaatccactgtagagagagttgggaaggttttccttccaccagttcatgatcccacttctttccatcctagcttcggtagcagggcaggctcgctgaggaggtagagattgccctgttccatgtagcttcatgcacaaccctgtaacattgttctgggcacacagctagactatgtcttccagcctccctttagcatttggtagggacatgcaactgagttctagataatggggcatgagtatgatgtgtgccactttccaggcctggttggtaaaagctgcctccctctcacccccacacctccatactaaatgatcttgcctctcaaagactggtccttggaccagccaccccagcatcacctgggagcttgtgagaaacaagaatctcacatccacccccaggcctattgagtttggatctgcagtttatcaggatccccaggtgatcggcatgtacataaagcagtgagaatcattggcccattctattttcccatctaccagctgaatgtcccagagctcaagagcctaggagagggcagtgcaccataaaagaagccaggttccctgaatgagcacaaccacacagaaggctactcacctattaggagcactcatcttggattttaagtaaaaagggaataaactattattcagctacaagtccctttatttaaggcaataagatgtgaaacagtagctactaagcaaagttgcaagacaggctacctaaggatatcattaagagcagcaagccttggtggtaacttgggaggcatttgaaatagaatagcctaggcaaaggcacagaagcatccagcaatgctagtgtaaggtcttgggggtggggggtgggatccagcggccatctctagccccttccacatgtagcccaccttatataggtctgaccacaccctccagaaaggaagggagcctatctgcgagttgagctcaagcgcgccactagagattgctcaggagtgaaaacccttgtatatcatcagctctgtggggcccgctttgatcaacaggttggcataattaatatcatcccagggctgtcagtttcctggagatcaaaaatgagccggtcattacgccaagatcagtcagaaacaagaaagagaaagactgtaaatacattcttttcccttctcccttaaaaaaaaaaaatctactaacgtgataaggaacataaaacagcattagtttcctcatagttattatacatagcactgaaaattgtggaattaaaccaggaagtactctctggctggccataaattttgcatttttccccttcgtgcataataatgccttgataagcgcctcgttattgatgtgtctgcaacacagatctcctttttggaggcaaaatgcttctccatagcagatggtggctattgtgtttacacatgagcacctcaggattgcatttcctcacgtcggcagtaaaaagaaagtcctaattgagtttttaatggctttgcacattgttcattaagattacatgagtgtgctcgggcgactggcagctgagggccttgggcaccaagagctcagcatggtccctgcagacaggtggccccgccagctcccagtgccagcacctacttgaagggaatggatgctggtggggcctcaaatgctgccaaaagccaagcagctgtggtgacatgaaacaagttctggatcttcagttaagtaagctgggtttcactccagcttctggcatttcttagttgtgtgactttgagcaagtcagtaaaattccctgggcctcaatgccctcatctataaaatgggataatgaaacctacagatcaaagttgtttgttttcagtgaatattaagtaaaaacggtacttaataaatgctaattttataacagatagccaacagcaggtaacagtgagcccaatgccgtttataaaaccttatgtttattgagaacttattatgtgccaggcattgatctaagcattgtttagcaccctaatgaggtggtgccatgcaatctctgttttaaagcaaggaatacgaaggaacagagaggtaaagtcattttcttaaagccacatagccagaaagtgataaatactcaaaccaattattccttcttagaaagcagagactacagggtctaggaatgcactttcctaaccagtagctaataacgccatatgcctatttaaaataattaaaattaagtagaaaaaaatcatttacttagagatactagccacatttcaagtgcccagtagacatacatgactggtggataccatattgaacagtgctggtgtagaatacatccattgtcacagaaatttctgttggatagcactggtcttgaagttgtggattacttaccaaagcataacaaattacatccaagtgagtcacaggaacttaactaacccaacctactcattttataaactccagtagggaacaagtaacttggccaaggtcaaccaacacaatgaagatttagactcagattttccgactccgatttcagtttctaccgcagacaactctgccgttccttgcccgagctgtacagccacagaagtggtttcccagatagctatttaagagggaaaagagcatatgttgccttcaggaagcagaagcatagaagtcctaggcattctacatgtcacatgacttaggagaagtatgtgcacacacgttgggcattcccagcctcagctttgacaggcagttcaacaactgtttgttgaggcccaagccctggtgagcaaggacaatgtaggatgcttctaacaaggggtccctgggataaactggaacccaagatacatctcttctctctgatgatcttaaacaagtcacttaactctttgactctcaagtaccatcttctataaaatggttataaaacacatctcatattgtggcctcatgtaatccatgaggattaatacaactactatttataaagtgcgtagataagtatcgctgcatgtaggtcctcaaaaacagcttcttttctatctttcccatacccctaaagttttgtttcagtgtagcagggagaccttaatagactgaagaagaaaatagtaagaaatccactgagaggcagagtaaaatctgctgccccgtctccacctcccacaattgataaggcatcaaggtccagggatgcctcctccttttgtttctctgaccatcttcttcctttccactcccttggcactggcctaattcaggtccatggcatttgtgtcagaaactgtttattttgcaacgacttcctaagcagtctagtccttgattctctcaccatccaataaaacagtactcagcaccatctttctgagatacaaagccaaccgtgacatgttctcgacttccattgaggtcttcctttataggaaattccccacttcctataaagcccaaggtctttcatgagaatatgtggagccttacacatcctgacccccacccctcctgcctcttatatgaagactatctctcccaccctcccccgcaaacacagtcctcggccactttgtggtagacagaataagggcctcccaaagatgtccatatcctaatatttgaaacctgtaatatgttacctttcatggcaagagaattaaggttcagatggaattaaggttattaaccagataagcttgagatggggagattattctggattttccagctgagcacaatgtaatcacaagggtcctttaggtagacaagggggccaggagagtcagaatcacagttgaggagctatctgaggaggctatgctgcttactttgagatgaaagaaggagccatgaaccaaaaactgcaggtggccagaaaaaaactagaaaaggtgagaaaacaaactctaccctagagcctccagaaaagaatgcagccctgataccttgaatgtaccccagtgtgacccacttaggacttctgatgtccagattagaatgtgtggggtttcggccactaaatttgtggtaatttgttacagcagcaataggaaactaatacacacttcaaacatcctacgcatgtccctgctgctaggcttttgcccaggtgatacccttcctgaaatccacgccacccagctcagccatggtccttcattaaactacttaaatatcactttccctacatggctttcactaatgtccaggaaacaggcacttctgaattgttgttcctatacttcagagtgcatacttccattataggtattttaaacaggatctaatttaaaagtccataatgatgaaatttagctatctagtcataataaaagtgaaagtggcacaaagacatcaaaaggcacaatgcactttcaagtaagataatgtaggtgcaagagaagcagatagtgctaccagtattaccatgaaaactagtaatcatcaagccaattgcaaacataacaatagaccaatagccataccaataaacatatcattcaacattattcttattatctatgaaagcaatctaattatcaagtgtcaaaaaaaagaaatctgctgcttttctaatataccagaaaatggggaggtggtgttaattggaacttaatggatatataatacctatttaaaacaaaaaaaagatacatcctgaaacttcaaaggaattgaatattgtgaacattttgtcactttgcgtgaacaagtaataagcatttctgtaaccattcattcagaccggtaagttggggtttcagcatttcatatgcaaatttgttaaggcaatttttgaagaaacaactatctaataatccatgtagctgtggataatgtcgtttaaatatggtattaacccccagtgattggatttgaaggcgcactggtggagaggctctgctaaccggtgctggataccctaatgcaagcagagtcaggcagggagtttgtgtgcacgtgggtcttttcctcaaagaccaaatccctagccgcctgcattcttttacactttctgagaaaaaaaggaaggcagagaggaagagggagagacacaagacaaagaaggaatggagaaggggaagaagaaagaaaagaaggagaaaacaaaagagtaatgaaaactaagatgaagaaaggagggaaaaggggaagaggatggatggaagggaagaagggaggaaggggaacaagggaaagaggcagaaggagaagcaggagacatgaactgcaggcgagggaaggggtactgagcagggggagagaagaggcaaaagattatggagacaaagcagaataacatgtaaactacacgcaacccctacataagcttgcatccctcctgacctcccaaacaaaagcaaaagtgaaaataaagactttttacccagcatacttcttctggtccttccaatgatgatgtgatgaaaacagaccccgggacaatgttgcagggcatactgggacctgcgtctccctttattacttcataacttgccttccccaacaattcaattcaatctcccaggagcaaaactaaatgttattgtaggaaaaacaatggaacccaaaacacaacagaatgacaactcagcaacataaactgtaaaacataaggtcttgaccgatttgctctttgatgttggaaatagacaattcatttggcaaagtccagatgaaactgaaggtcagataatgctactctcccttcagactcttcacctcttcctatgcacccattttaaccacacactgccccgtaagcaagaattctgtctgtttcttcacgtgcaaaacaggtatatatacaggtagaggttttaaagttccttccagctacagaagtctgtttccaagactttacagcgactttacctgactagttagtggtaagtcaggagcccaggctggcttggattttctacctagactctctctgaagaaggggtgggaaggaaagatctttctccttgggtcttgttcccaaagaaatgcagtactttttgtgttctcatgagaatttatttatcttctcagtcactcctcttcttaacaataacaacagccaacacataccatcatgttttacttaagattcatttgtttaattcttatatcaaccctatgaggtagtgactactatcattcttcttttacagttgggaaaactgagaaacagagagcttaagtgactttttcaaggccacacagctggtagcagagccaggattcaaacctaggaagttataattctcatttagctgctaggctgcacaccacatgtgggcacgttgtgtttgatggcaaggagtgatcatcaactccctggagttagctggccttgcgctggggagctggttcatgcaggaagaggggtaaagaatggaaagaacgaacaaaaattaagtcagttgtcaagctgctgccatattaagagtaaagagaacaacagggctgctgggaacattgtcagaccccaaattgttcttgacattcattgggctgagtcccttgcttctgcagctctaaatggaaatgacatggaactaaaatatatatatttttaaatctccaaactcttcacacatccgttggcatgataatattttgattagttacatttatgctccaattacactcacagaatgttcaactgtgtcttatatatagcatgtttgccatgctccatagaaaatactggattattacctcgtatatttgcaatgggaaaagacacaaatggaaagggggagaaaagacagcaaaaagaagagatgactaatcctgttaaaatggtgccgtcttgccttcacattactaaattgggtcatcgctattattgccaagctttaaaatgccagggctgggagagacatcaagtatttaagtctacccttcccctcacctgaggcttttatctcccttaccacgactgggtctgaaagcaacctcctcacatacccagtgagtggcaaggtcgacagtggggaatgtttgtgtctttgtgctctttttttcttcctggggagagcatccatctatttctcaaagagctccataaccctgtccaagataaatatataaataaataataaacagaagctaagagttactctgagctttgcaaaatgcctgccctggggatactaggagtgacttattaccgtgtgtgctgcccagatgccatcacattattttgctcttcactagtagcccatgctgcaagcactgaaggtgcgtgtatcacaccatctaacgcggataccaggtggaaggggtcccatggaggtctgctaaagatcgcccccagttccacagcacccgcccctcaaatcctcaactactggagctggctttctcccctggcttctctctgccactgcatccctaactccactggtacctctatgcctcagtttccccaaggtggttccattcatgaaggctaacccctccaccagtctccttatgaaatccaccaaagccaagcatttcatcaagttaataaaatttgttctaaccacaagtattatttgtgcacctactatgtgtctgacactaggggaacagcagtcagcatggaagagtttttatcctcttagagattacagacttctaaagagccattacaggaatgtggaaagttctatgacaaggcaagaacccagacttgatttgggggaagaagtataaaaagaaaacacctacaactttctggagcaaataaactgtaggctgaggtctaagttatgtaggtgtcagacaggggaaaagggaacagaaagaatgttccatgcagatgaaatagcctgtttcaaagccaaggaacaagacagtttctgccttgtgggggggctaaaagaaattgcagacagaatgcaagtgccttagagaccacctctctaacctctcacccttcagtttatatataaggaacttgatattcagagaggtgccctgatttgcccagagtctcacagccaaagggtgatagagccagcattcaaattgaggtgtatctgactccaagatcagtatcatttccctctgaaacagcggttcccaaatcgcagtgtgcatcagaattacttggaaagcttgttaaactgtgccgggtcccatacccagtagatttggggtggagtccaagaatctgcacttctaacaagtttctaagtgatgctgatgggactgatctgtggaccacactttgataaccactggactagctggtctctaattccccagccctgatagggcaggggcccaaaaatttgggcgaatcaacaaatggtgctaccacaggggtgctaacttgttaaactacctcctaccctgggccacgccctgcctacctctctcaggggcaggaggtcttggccactggccattaaacatgaagactctccctctgcccaactccaacagcctgagccattttctttccatcactgctaattaccaagaatataattagacacttattgactcccccaaatgtactaaggtctgcaaagaaaatagcacaataattattcctcctattttaccatcctctaaggagctacaagactttgacagctgttatccaattaatcctgacagcttatttttttaacgtaaaggtatttttttcttctaagattggaaaagctatttccttttttgaagtaagaatgagggcaaagagaggccagataacttgtccaacattacaagggtcatttcttgcctcccttctcctgcatgatcagtggaacaatgaaagataagggcatggactgttgactcaaactgccagatcaaatcccagctctgtcagctctcagctgtgtggccttgggcaacatacttaacatctataagcctcagtttctccatctgaaaaatggaggtgatgatggcaaaagttgtacatgcttcctaggcttgttacgtgaattaaatgtgtctgtatgttacacgcttagaatagtacctgacatgttgagaattagctaccatgatcatcagtggcagaagcggcatttctgagccctcatgcagatcttcgactacaacagtgagataactgaccctggaattcagcagggtaaggcaggtcccagtctcactgtccacagaggcagcgggcctagaaggcaccaggaagccatggaacatctccatgctgttgacaacaaggaacatctctctttgccagtggttctccaagtgtggccctgagccagatacatcaacgtcatggggaacccctcaaaaagtaaatccttgggccccaagctagactgactagaccagaaactctgagtggggtcagtcatctgggtcccccaggggatgctgacacccactcaagtttgagaaccactttttttccccagacaggttgcctgagcctcagcctatcagggtagaccacaataacctggcgatcatgccagttcctgtccactggatgttccctgcttttcccaagaagggacaggacaggttaccagattccacagcactgtagcatgggtccagagcctgtgcttttttaattatttattatttatttattttttgagaaggagtctcgctctgttgcccaggatggagtacagtggcatgatctcggctcactgcaaccttcgcctccagggttcaaacaattctcctgcctaagcctcccaagtaactggaattacaggcatgtgccatcatacccagctaatttttgtatttttagtagagacagcatttcaccatgttggccaggttggtctagaactcctgacctcaggcaatctgcccgcctcagcctcccaaagtgctgggattacaggcgtgaaccaccgcgcctggcctagcctgtgttcttgaccactgccctacattgtctctcttgaaactgccttcccacatgcacttctggaaaggactccaatccctaccccagtgagggccagctgggagtgcggtccttattgctgaggcaccatagttgccctggtgtgccaggaggtaggaaatggacaccaggagataatgacgactcacagaaatgacacagaaggcatctcccagaccctctgagtccttgaagccactaggatatgtccatcaactgaggcctcttgaaatcaagcacctgaacccctagattttctacggttttcatcctgaacccactcttcccctttcatccctcactcctccacctgcccccatcctctcagctgcaaagctagtttcctatttcagtcttacctttctcccattccccatccctagccctcctcccctgtcccactttttgtaccaaaatgcactttggactatcccccttgaccacaatgcagaccccaaccatctcttgggttccccttcctcttgctgctgtccacctcatccagtcaagtggtctctgcactctagaccaccaaagatactgtctctgtcagttccaccaagccctgcagtagaacctagacccagatggaaagagaacaagacaaaatcaggaagtagaggcagctctagtgctgacaactgccagggaagcaatgagctgaatgggttccctgaagccgccataacaaagaccacaaagtgagtggctgaaacaacagaagttgatcgtctcacagtcctggaggctgaaagcctgagatcaaggtgtcagcagggttggttctttctgaggccagtgagggagaatctgttccatgccctcccctagcttctggtggtttgctggcgatctttggcattccttgggttgtagatgtacccctcctccttatctctgccttcagattcacatggtttatccctgtgtgcatctgtctccatttgttaaggaaaaaacaccagtcacatcgaattcagagcacaccctactccaatatggctttatcttagctaattacatctagaatgactacttccaaataaggtcacattttgagatactgggagtgaagacatcaacatatgaatttggtgggaacagaatttaactcctaataagctttctagagccctactgtgttcatcacccaaagagttatctaaggcagtcctaggagggtttctgtagagatgacggaatatcatatttagagggagcatgggaaaatattctttttaactataaaacaatacatggggaaacaaacagaaaagtagaaaggaggagtgacaagtcctcacggaaagacagccacacatgtcttgaggtatttccttacagtctcatttgctggcataggttagtgctttccaaggagttatggcatttacttgggtttgtgactgtggttagtaaatttttcctgaagaagaggcttaatgggggataacagtttatagtggccttgtctgcattgaagctatatccaaattccaatgggaaaggagcaagcaccccttcaacagggctgcctgttcactgatgttgcaggttagtttcacaacaaatgtatattgagtgcctgctccacaccaggcactgttgtaggccccgggagtacagctgtgaacaaaacagtgaagatacttcatcagagacagtttgcggagatgaaaatgctcctcaagagctttgaaacaagttgaatagggctcctgtagacgccccccagggaatgcatgccagtttttcatgccatgattaccccttttaaaattcttgatttttagctcatctttcgaggctctgaagtacctttgcaacgattatttccccaggaaggatctatgaatggtgtattttctgagcctgtgcatttctgatgctgcatcacttttatagtatagatcacgtgcccatatgcaatttattgagtctcgacctattcccttctaaatactgtggaccggtgcttctcatcttttgccaaaagaacaaggatagcatgtttgtccctcatctgtcaaatcctctttttgaatatacacttggaaggcaggtagataggtatatctcacaccctaattcctaatatagggaagatttttttttttttttttaatcttacagccttgttcttaggagcacagcacagcaatgaagatgcaggctctggagccacacccctgcagtcaaaacccagccctctcatttcctaaagtgcatccctgggcaaattacatagatttttctctgtctttgtttcccaatctgtaaaatggagataataaaaagacaaacctggccaggtgcggtagctcacccctgtaatcccagcactttgggagtccaaggcaggtggatcatgaggtcaggagatcaagactatcctggccaacgtggtgaaaccccatctctactaaaaatataaaaattagctgtgcatggtggcgcacgattgtaatctcagctgcctgggaggctgaggcaggagaatcacttgaacccaggaggcggaggttgcagtgagccaagattgagccactgtactccagcctggcgacagagcaagactctgtctcaaaaaaaaaaaaaaaaaaaacccaaaccttacaggatcctcagttaagcttgaggattaactgaattaatacaggtaatagtagaaaggctgacaaactttttccataaagggccagagagtcaatattttaggcttagcaggccgaaaagtttttgttaacaactactcaattctactgttggggtgtgacaactgcagagacaatggataaatggatggatggatgaggctgtgttccaacaaagctttacaaaaacaggcagctgaggggtccatgcataggctgtagtttgctgacctctgacttagtaccaggcaaatactaaattctcaatcaatgttagccattattattaactatgatgagattcagaaggacaggggttggatcctctctgtcactcactgcctggttctctgacactatgaacagatggtgtacatgaaaaaccaccatccacagaagtattccttccagcccacctatagcactgcacttgtgaaaacgacaccttccaagatgcaatgcgctgccacaatgtctctgataatttttgccctgttgtatttgtgagtttcagccttgagcaggatgtgaaaagaaaggtgggaggaaaacaatagaacattaagtgcttcagaaagtcctcttcatgctgtaaagggatgtctgtcccatttagattggtacagacctttatcttctactagagggacagagaaggatggatgcacatcttccttttgttagtggcacggcataggtggctgagctctgtttttccgaccattcctattagccttggagttgagggaaaactctcccagattctgtcaaaagttcacctgtctcactttccagtgttgctatgatctgatgcttttgtgctgttctcatgggaatttttaagggaaactgcaagaggttgggattcccaaagtctcttaaggttatttccaccatggactctgtgtatggtggaaagagttcccgagccctgtgctctctgtggcactgtctcatttcaaacacataaatccaatgctttatctacttcttgggattttctggttattttttttaccacctacaccaagggttaagccatgccccacttttcccttgtcctgaccaaaattgatatactacgacccagggccaaaagcatagacaacaggtgtgggcgaaaattctctacttgtatagaaattatttgaagaaattcctgcttaatcgggcttcaatctcttccactcccttatatccattcatttgttcactcattcattcattcttttactaattatgtgcccgctaaacattcactgagcaagctttatgtacttggtaccaagcatgcagagacacagaataaatattttattcttgaagacatcttgctctaaatgggtatggtgcatctggtgatgccctgcccaggtctctctttaaagaaacttgtctccccagctgccagggcacttaggcacacagtctttagcagtagcccctccagggactgtgtcagctgcagagtgtactcccaaggtctgcctttctgagagctgcacatccagcaactgatggaggctagggttgaaagcctcagccagtcctgcccgttgcagactcggacgggccattttagctccccgtggagttggctaatgatgtcctgaggtctgcgtcaactcacttcctcccgcagcctgctgctcatcccttccttcccttccatagctgctagtccagggggcaatttccaataaacatcctaataaacactcatctccatctctgattctgaatcccagagaatccaacagtgacaatgggtctggggaagcaagttgctctgtctgggcatttttgaggggacatttgcgttggttctttaaaaacacacaggaatattccaggtagagaaggaacgatcatttcaggcagagggaacaggacgagaaagtccaggactatgacagcacagaggcatttggtgtcctggcctgactggtgagaggggatgtggaggcccaggaagaggaccaaagcaagtccttgatagtcaagctaaggagctgaccatgcaccaggagcccatgggtgtttatcagaagaaatgggacgtaataaaatattcatttcaccgagatgagttgtctttgtcaaggttccctctaaaaaacaggagctaatctggatgcgtcaagtagatagttttcatacaaagactcagacctttatccactactgggaggctggggaatgtcagtggggaaggtagtcctcaggaaatccctaagtataaggaccacaggaaaagtcgagtctgtagttttggctacttgggtgactgttgggtagatgctcaacaaacatgggcacacctcaaagtctgctgactgcccgcacccctgcaggggctctcagctgccggagggaggctcactgttctctggttctttgacctttcagatctctcatcagtgggatctcactgggaccctgcaggtgaaggaatctgggaaacgtggcttctgggcttcatgaccctttggtataggagagcacttagggagctgtgcatcaacaagcaatatgtgacttgggtcacagaggatgtggctgcagcaaggagattagttagggggttgaatcaaaagcccaagcacgagatgttggtgccatcatcacgtcactgcccaattctccttcctctccaaggcctccaaacctgctctgaggcttggcagggaaagtgagccagactgaggacaggagaaagggctgccggaaacaaacgcaagggacacacagccctgtcccgccaggtgtgactccaggtgccaggtgtgactcctgccaggtgtggctcccggatcaggatggctgctcttcactcactggcatttgggtgagaagggcactgagatggagcagggataaccaatccagaagacagaaaccctggcttggagccctttccagccatttcctaattggatgtatgacttttctagggctgccggaacaaattaccacaaacttggcggtttaggataacagagattcattctctcacagttctggaggccagaagtctgaaatcaaggtgggtcggcagggccgtgggggaagtctctaggggataattcctctttgcctcttgcagcccgtggtggtgtctggtgctccctgaggtcgtctctgcctctgttttcacatggtcttctcctcatgcctcgcatttcaaatctccctctgctttgctctcacttttgcagctatcattggatttaggatccaccctaaatccaggataacctcctcttgagatccttaactcaactgcatctgcaaagatcttttttctacataaggtcacagtcacaagttccaggaattacaccttgcacaatgctggggggccgtgattcaaccccactacaactacactgggtgactctgtaaatgtcacttaccctcatgcttagacttaaatttgtactaataaaatagagtaggggccgggcgcggtggctcaggcctgtaatcctagcactttgggaggccgaagtgggtggattgcctgagctctggagttcaaaaccagcctgggcaacacagtgaaaccccatcgctactaaaatacaaaaaaattaactgggcgtggcagcgtgcacctgtagtcccagctactctggaggctgaggcagaagaatcgcttgaacccaggaggcagaggttgcagtgagcagagatcatgccactgcactccacactccagtctggctgacagagtgaggctccatcaaccaaaaaataaaataaaataaaataagagagtgcgaggagaagatgacctacctggatgttggggtgattacataagacagaacaagtcaaagccccggcccacttatacacacaagggaagcctgaattaaatatctattgaatctgaatcagctctcaccccacggctatgggactggtctggtcaggacctggagactcctagttcatgcagcgtaacacaaagctcagtttgcatttaggattgcactagattgccttaaaagcagtacgcagttctgaagcttaccattgtataaaataatacctggtgtctatagtccttcatctgttcaagtacaggttggatggaaggatttccagattcctgtggatttaggattcctacaatactgtgggcatcagattcactgcaagtaactttcccagcaactgaaacactgttcccacccaaaaggggaaaatcagatcacttccacatggtggaaaaactagattacttccaccatagaagtctttcgacgctgcctctcccctttgcccgtccaacccgccccaggtcttaattcctgtccttctatttaggtttaaatcattgcacaatcactttctgactatataacttagaacaagcccctttgtacttcatttgttttccttttatgctctttaaattttaataaattaaaagtggcagaaaattgagaaagctacaaagaataaaattataaatacccataactctgccatctagcttcaaccactgtgaacatcttaacatatttgctttccctttttatttttaaagaagaaagattactttattgttattgggaaatgatacatattcattttgaggaattcaagaaatgcaaaatacaaagattgaagtttaaaaaaaatcttaagtttcactacccagaaataactgtcattaacatatggcaaacatcattttaaatatcttatgatatacacagagacaaaaggacagacggatggatggatgaggatgggcggatggacggaagaataggtggaaataaatactatgaaatgtgggataaaatatatgtcactttaagtttttttttaacactgtatttgtctttacttgtatgtagcagaagaaaaagaaattaaaacaaaattgaaagaaaactagcctttcaaatacttctttaccaagagatacttacccaaagatctctttaagaacacagattgtgaagaaagcattaagagcttgaagtaattatactatattttaactatttattttgatgttaagcttatctaatgactccatgctgtcaaatatggtattagaactatcacacttcccctcaacttctcctccctctctcaatttctcagttttaattgttggtggccgctgttgttacactgcccaggttttaaccttcataccctgatctataactgtaattgtctaagttgcttactgtgagtcctatatttatatggtttcattacttatcatcaatccttatgttatgaggtctgcattcatgaatcttttatttttgtttgcttttaattagttgtattttgtaattaagtatttttgtcaagatcttatggatattacactgcctgagtacatttactcttgacaaccatgacttgtgagctttatattctattatattcttgaactatgctttctttccctcaaatcttttagataaccattctttcatctttgacattgaatcctgctgtagagaagtctgaggacaacttgactttttttttctccttgtggaggatattcttgtgtctagaatactgggtaattctgtatttatcctaagttttaatagtttaactagggtatgtcttggtatctagcattctgtaccaaattttcctggaatacattgtctctttattattattttactacaatatgtaacataaaatttagcattttaattattttaagtgtacaattcggcagcattaattactctcacaatattttggaaccatcaccattatttatttctaaaactttttcatcaccccaaagagaaattttgtaaccattaagtaataactcttcattctctcctgccccagtctggtaacctctaatctactttctatctctatgaatttgcgtactctagatattacttataaatggaatcctgtagtccaaaaatgaacagtaacaatttttgggaggatatggagcaactggaatccttatacactgctggtgagtaggtaaaatggttcagctgcttgtaacacattctcttttgatttgcacattcagttatttattcgcttcaggattttttttttatccagaggcaaaatagcatcattctactcttttgaatcccaattctgttatatatactagacatgttgccttgggcaagttacgtaactatatcttaatttcctcatctataaattgggaatactaattgtattaacctcaaattgttgtgaaaaattaattcatgtaaacctctaaataaatgtttcatgcataatcaacgccaaaataatttgttattgttgttatactaagctatattttgttatatttgaataaataaaaggttatatgtttatacctttagagtatatatctttatgtctgtatctattgtagaataaattgctttctcctttagctttctttatgttcatattcagttgactactttcaccactctatttcatctgtattcatgtgcttgttaagacttccctctacactgttttttccagcaatgtatattctattttgtttttgtattgtttcactttttgctgtcattatttatgggctctttaatcctattaatgctattttgggcctcaatttgtttccttttgtccctattaatctcatgctgtccatttattccattatcctgaaccctcgctttattgacctggtgttcatatcaaattgttctatagaatgaagcaattgtgaataatttacctctgtttctgaaatgttatttttttaggttagaatccttgcccttgtatattacagccccctgcttgcttgcatcccttccttcctttttcttccttccttccttgccccctcccttcctctcttcctccctccctcttttccttctttccttccttgtttcttttctcttcctccctttatttttttcaaaattagtatttgtggtatgctttaatgttgccatgacatttcttaccttcttgttctgcctaggtgactccactcgggtggctccatcctgacatgccatttgctatgatatatagcatatgtgacacctgactttcttcctaccatatcagggaagtttgttttccccttgaagtttgaagattgagtattctttattctgtctgatttctgagcctaatgaaacagtgagaaggaaggagagagctcatctaaggtgatatttggtcattcttagattactgggcatctgtttcttctttttagattttgtgaatatcccatactcagattcactacatctacttgcaggtatttacttttctgatgagaaggtagtccctattttcatttatcttactcaatttagaagacagtcctgaagattttgctaccattagagaaagttaacctcctccataacccccttcctttgctttgtttatacccccatcccggccccaagccattttttcttattacttaatcatatgagagaaaggataatgatacccagtaaacttgattttctctagatgtttggtattgaggaatccccaaactatgttactaatatgctttttggtgggtggggaaaaagatttagaagcctagctatacctctccacatcactctgtgtctcctgtttctttccatacttaccagtgtttaaaacttgcatttgatagttttctttcccttgttttggtgttgtggtgaattttatttatttttcttttcttgtattcttgtttgctcaatctattacgtatttgtcaagaggaattctgtaattcagtttctgtcagtgatcttaacgcaaatatctgagtcacactttccataagtaagttgggataataattataatactgaactcatgaatttttttagaagtactaagttagataatatatgtaaattgctttgcaagctctcaaattttatatgaagaatatgttttcaataaatgtagttatgaatgaatgagctgttattactctgcagtaatgaacttagttatctaatttataggattataaaatgttagcacttaaatcagtcctaggaatcacgtagcacattccatttattttataaaggaagcaaatgtcatgactgccatctttagtgccatgtttcatcaggaggtgggtgacacaagaattctgtggttataattgatggcaagcatgtcattcataagaattctccttgcaaataaacttcatgtgttagaagaaatatttttattcacttctcagaaggaaggttttttcaatcagaaggcccctattttgctgaacaccaacattagtttaaacacgcaagcttgtgggaagaacccagaagcaaaacctaattgccttccataacagaggggaaaaaagtacaacagaagagagaaaagagatagaacaagctagaccaaatgctgagtaagaaaaatgaagagttaagtaaaagcaatgggggtacaggtgagaatgaacattgaaaaaaagatggtctgatattaattttcagttgtttcctctgaaaggtatactttctccatctcacacaaggaatatttattaaagtttatactattcactgatgtttttgtagtaggtttttgaaaggcttagtcctgaattcatttagatcttagtaaagaccaagcagacatagcacgttcatttgcagaagctaaagagtatgggatctactgaattatttatgttggtcaattgtgtcctcttatgttcaaacacagcactggggtaggggggatagagtgtggtagagggctgagctgaaggagcttagcgtttgtcagatgactgactgaagagatgagtttaaagctaaagggattgccaacaccaaggatggaggcaaagctcaaaccatggtgaaaatcagaggttctgatacatggcaaaggaaaccagtagcaaagtaagtttacaacatttgcttcagcacaacaaggaaacattttttctgccaggtcaaacttagaagttgtcatctgcttcctaacgcaccttaggaggttcatccaagcctgatattaagataaaattaaaaaggtacaaaaataaatattttcagtcaaaaaaagcaaaatgatcactgatatttgtcttctagggcctctctgaaatgatcataagtggatttttaaaagtgtttaggctcacaaaaacaatcagggcaagagagaggctgagttgacagggcttctcatcaaccactttggatcctggggagaaatgtcaccataacttcaaatttttaagagtgatctttagtcaaaaattgtatacccagcaaaactatcaaataaattagacccagacattttgagccacacaagactacttactctttcttgggaaattatatgagaatgtagtcctgtttgaacagaaaactttttttttctctttttttcatttcattttaatatcagggttatgaacatctacaaaaatgagtctggaggaaactttcaggctgggagctggcacacacacaaaagtcttctttcttgggctgaagccagtaatactaactgtgaaaagccacctcatctcagacgacagccatgattaatattcagtgaagattggaacagtaggacaggtggctctggaagtgagtaagatctctcatgaaataagagaagttgatagctcagatgctatgataaaagtaagtagtggggtgtaagtaaaagagagaatcccttcaaccttaaaggtaggagcattctcctttgagaggtagagaagatatgctcgagtccagcagaaaaggaaatataatcctagcacacggtttggttttgcaatgaaacaatttacacagtaagaataatggaagagctatgtatccactttcaacttttagaatcattaaactgactgatatggtttggctctgtatccccacccaaatctcatcttgaattgcaatccctacatgtagaaggagggacctgtaatccccacatgtcgaggaagggaggtgactggatcagagggaggtttcccccatgctgttctcatgatagtgagtgaattctcatgagatgtgatggttttaaaagtggcagttttttcttgcacagtcacactccctcatgctgccctggtaagaaggtgcctgcttccccctcgccttctgccatgattgtaagtttcctgaggcctccaagccatgcttcctgttaagcctgtggaacttgagtcaattaaacctctttcctttgtaactacctagcctcagggaagttctttacagcagtgtgaaaatgagctaatacactaaccaatcatgaaaggcaagaatcgttatggagaaaagcctaaaaattaccaaccttggccatgaaagcgtaaaaacaaggatgacaatgtcaaagacagaggtgattgggagaaggggagatcaacaatgtcttcctcaccttacccagaagaccctgatggttcctagaacaagaagcagaggctgaagtaaactatagcatctgaatttgcaaagattaccagtggtagacataaaaagtaaacatttactataacagaagctagaaagtgatttaaaagggcaattcctcatttttcttagcagaaagccagtagacaacatattaagttaataagtcaagaaaagcactttaagtaaactacttacacatgtagaaataaccaccaaagaagcaaaaatagaaatggatgacctgtgagggcgggatctgaaaggcagagaagccaaacagcatatggtggtttttaaacatgaacccttctgagttatttgacatcttaatcatgtttggttttttttttttttttggtttaacagatctttgaaaatgaaattaaacataaaactatagaacaatctcacctatcaatgtgtacacaataatactccctgaattaaattaaattgtgatatgaaaaagaaatatatgtatattcagggacagtatgcttattctaggaaaggaaagactgtttgaaaatataaaatgccttttgttatgatttcagcaggatgaggtgagaaaaacaatctctaatccattgttgcggaagaggcttttggtaaaatcttttcaatatttttggctttaagaaagtcagtattttatgctggagccagggaggctggagggcttgatcccaagatttgtccccacagcccaacacactggctgtggcagtctgaggccagcgtgcctcttcaggcctaaccctgacctatccttcctcattgggcagggcttccctgcagaaactccaataactccagctagaggctcaaggacagaattcggatccccctggacctgagccccggcgggaggggcagccacagtttctagggaccagcagacttagtctctcttcctggtagctctgaggaatccaggcagcccagacaagtaggtttccccccagcaaagcacaccctctccaccaagtgacaaagtgtttcattaaatgggtcctgatccccgtgccacccaactgggtgagcccctccaacaggggttgtcagataccctatacaggagcaaccctactggcatcagtctggtgcccctcgaggtcagaggccccagaagaacgagcaggcacccatctttgctgctccccagcctccttgagtgacatctccaggcacaggagcaaatcagatgactaggtcctaaagtgaacccccagcaaactgcagaagccctaatgaagagggacctgactattgaaataaaaataaagaagcagaaagtgacaacaacagcatcaacaacaacaacaacaaaaagacccaaaaaaaaaacccattcaagggtcagcagcctcaaaaacgaaaactaaacaaactcacgaatatgagaaagaatcaacaaaaaaatgctgaaaacacaaaaggccagagtgcctttcctcctccaaacgactgcaacgtcgttccatcacaagcataaaactggatggaggatcagacagatgaattgacagaagtaggcctcagaagatgggtaatgaaaaactaagttctaacccaatgcaaataagctaagaaccttgataaaaggttacaggaattgctaactagaataaccagtttagagaggaacataaattacctgatggagctgaggaacataaattacctgatggagctgaaaaacacagcacgagaactttgtgaagcatacacaagcatcaacagccaaactgaccacgcggaagaaaggatatcagagtttgaagatcaccttactaaaataagatatgcagacaagaatagaggagaaaagaaggaaaaggaatgaacaaagcctccaagaaatacagggcttcataaaaagactgaacctacaattgactgaagtagcagaaagagatggggagagtggaaacaagctggaaaacacacttcaggatattatccaggagaactgccccaacctagcaaggcaggccaacatacaaattcaggaaatgcaaagaaaccattaagatactctccaacaagatcaactccaagacacacagtcatcagattctccaaggtcaaaatgaaggaaaaactattaagggcagacagagagaaaggccaggtcacctacaaagggaagcccatcagactaacagtggacctctgggcagaaactccagaggccagaagagattgggggccaatattcaatattcttaaagaaaagaattttcaactcagaatttcatatgcagccaaactaatcgtgataagtaaaggagatataaaatccttcccagacaagcaaatgctgagggattttgttaccaccaggcctgccatccaagagatcctgaaagaagcactgaatgtggaatggaaaaacaggtactagccactgcaaaaacatactaaaatataaagaccaatgaaactatggaggaactgcatcaactagtgtgcaaaataaccaaatagcatcatgatgacaggatcaaattcacatataacaatactaaccttaaatgtaaatgagctgaatgccccaattaaaagacacagactggcaaaatggataaggagtcaagaggcattggtgtgctgtattcaggagacccaacttacatgcaaagacatacatgggctcaaaataatgagacggaggaaaatctaggcaaatggaaagcaaaataaaaataaaaataaaaaaaaataaaaaagcaggggttgcaatcctaatctctgataaaaaagactttaaacaaagatcaaaaaagacaaagaaaggcattacataatggtaaagggaacaattcaacaagaagagctaactattctaaatatatatgcacccaatacaggagcacccagattcataagacaatcttagagacctacaaagagactcagattcccacacaataatattgggagactttaatacctcactctcaatattagacagatcaatgagacagaaaattaacaaggatattcaggagttgaactcagctctggatcaagtggacctagtagacgtctatagaattctctacaccaaaatcaacagaatatgcattcttctcagtgccacatggcacttatgctaaatcaaccaaataattggaagtaaaacactccctaggaaatgcaaaagaactaaaatgataacaaacagtctctcagaccacagggcaatcaaattagaactcaggattaagaaactcactgaaaaccacacaattacatggaaattgaacaacctgctcctgaatgactcctgggtaaataatgaaattaaggcagaaatcaagaagttctttgaaaccaatgagaacaaggagacagcatgccagaatctctgggacacagctaaagcagtgttaagagggaaatttatagcactaaatgcccacatcagaatgctaggaagatatcaaattgatatcctaacatcacaattaaaatacctagagaggcaagagcaaactaatccaaaagctagcagaagacaacaaataactaagatcagagaagaattgaaggagatagagacataaaaaaatctccaaataatcaacaatgcagaagatggtttttcgaaaaaattaacaaaatatatcactagttagactaataaagaagaggagaaagaagaatcaaataaacacaataaaaaatgataaaggggatattaccactgatcccacagaaatacaaactgccatcagagaatactataaaaacctcacgtaaataaactagaaaatctagaagaaattgataaattcctggacgcatacactcaaccaagactaaaccaggaaaaagtcaaaaccctgaatggaccaataacaagttctgaaattgaggcagtaattaatgggctaccaaccaaaaaaggctcaggagtagacagattcacagctgaactctacctgaaatgcaaacaggagctggtaccattccttctgaaactattccaaacaattgaaaaggagggactcctccctaactcattttatgaagccaacatcatcctgataccaaaaccaggaagacacaacaaaaaaggaaaacttcaggccaatatccctgataaacatcaatgtgaaaatcctcagtaaaatactgacaaaccaaatccagcagcacatcaaaaaacatatccaccatgatcaagttggcttcatccctgagatgcaaggctggttcaacatacacaaatcaataaatgtaatccatcacataaacagaaccaaagacaaaaaccacatgattatctcaataggtacagaaaaggcctttgataaaattcaacatcccttcttgttaaaaactctcaataaccttggtagtgatggaacatatctcaaaatgataagagctatttatgacaaacccacagccaatatcttattgaacgggcaaaagctggaagcattccctttgaaaactggtacagacaaggatgcctcctctcaccactcctattcaacacagtattggaagttctggccagggttaccaggcaagaggaagaaataaagggtattaaaataggaagacaggaagtcaagttgtctctgtttgcagacaacatgattttatgtatagaaaaccccaccatctcagccacaaaactccttgaactgataagcaacttcagcaaagtctcgggatacaaaagcaatgtgcaaatatcacaagcattcctttacactgacaataggcaagcagagagccaaatcatgaatgaactcccattcacaattgctacaaagataataaaacacctaggaatacagctaacaagggatgtgaaagatctcttcaaggagaactacaaaccacttctcaatgaaataagaggacacaaacaaatggaaaaacattccatcctcatggataggaagaatcaatactgtgaaaatggccataatgcccaaagtaatttacagattcaacactgctcccatcaaactaccattgacattactcacagaattagaaaaaatagttttaaatttcatatggaatcaaagaagaccccaagacaatcctaagcaaacaaaacaaagctggaggcatcaaactacttgactttaaactatactacaaggatacagcaaccaaaacagcatggtacctgtaccaaaacagatatacagaccaatggaacagaatagagacctcagaaataacaccacacatctacaaccatctgatcttcaacaaacctgacaaaaacaagcaatggggaaaggacatcctattaagtaaatggtgctgggataactgcctagccaaatgcaaaaacagaaagtggaccacttccttataccttatagaaaaattatctcaagatagattaaagacttaaatgtaaaacccaaaaccataaaaatctcagaagaaaacctaggcaataccattcaggacataggcatgggcaaagacttcatgacaaaaatgccaaaagcaattgcaacaaaggccaaaattgaccaatgagatctaactaaactaaagagctcctgcacagcaaaagaaactagcatcagagtgaacaggcaacctacagaatgggagaaaatttttgcaatctacccatctgacaaaaatctaatatccacaagttacaaggaacttaaacatatttacaagaaaaaaacaacccatcaaaaagtggcaaaggatatgaacagacacttctcaaacgaagacatttacgcagccaacaaacatgaaaaaaagctcaacatcactgatcatcaaagaaatgcaaatcaaaaccataatgagataccatctcatgccagtcagaatggtgattattaaaaagtcagaaaacaatagatgctagtgagactgtggagaaatgtaaatgattttacactgttggtaggaatgtaacaaccattgttgaaaacagtatggcaattcctcaaggatctagagccagaaataccatttgacccagcaatcccattactgggtatatacccagaggaacgcaaatcattctactataaagacacatgcacatgtatgtttagtgcagcactatttacaatagcaaagacatggagccaacccaaatccccatcaatgatagaccggataaagaaaatgtggtaaatatataccatggaatactatgcagccataaaaaggaatgagatcatgtgctttgcagggacatggatgaagctggaagccagcatcctcagcaaactaacagaggaacagaaaaccaaacaccgcatgttctcacttataagtgggagttgaacactgagaatacatggacacacagaggggaataacacacaccagggcctgttgaggggtggcagggtgaggggagggaacttagaggatgggtcaataggcacagcaaaccaccatggcacacatatactcatgtaacaaacctgcatattgtgcacatgtatcccatttcttcctttttttagaataaacaaaatgtaaaaatgaaattaaaaaaaaagtttattactcacatcctcctcaaaaaaagtcagtattttagatgtagaagaatactctattagaataacagcgcccatctgaagccaaagacaacatcatatataagagtcaaacactgaagccacttctattaaattcaggaatgaaacaaggttatacttacattattcaatattgatttgcaaactctaagcaataaaattaaaagggaagaaagagaaggaagaagttagaaagaaagaaattttttataataatagaaaagcaagagataaaattaccattattttcctgatgatatgattgaatacctaaaaaaaacacaagcatcaactcaaaaacttgcagtactgattaaaaaaaaaagttcagtaagatgagtggttaaaaaacaaatagataaaacacaacagctttcttatatagcatcaataaccacttggaagctctgacaagaaataaattaaatcccatggtagcaaataactaggaatcaacttaaacagagatatgagaggtccagatgaagaaacccacaaaactttactgagggaaataaaagaatccttgaaaatgtgaagatacaggtaacgattctgagtctgaagactcaataaagtcaagatggaaattatcacaaaaataatttgagcaatattttcaattcgaataaaacccaagaggagttttctggaacttggcaaaataattctaaagatcatttgaaaggagacacaaagagtctctctctcttttgttttgttttgttttttttcataaagtgtaactagaagagaatgtcctattaagaattaaatacctagtaaagccacaataattaaaagagtgttgtactgacataaaaacagacaggctaatgacaagaagaagaaagaacatcaatagaccatatatgagaatgcatttgatgagaacagccccacttttaatgaggggagaaaggctaaactattaattcatggttctggaatactgattaactatagtatttgaaaaaacaatggacttagattctattcacatggtgaatgaaaaattaattaactagctaattaattaattcataactataaagagttgaacatgaagaagaataaaaaatcaaatcattaaaatctagaaaaatacaagagaatatttatctcatttgggaatagggaaataacttttgaagttcaaaagcaaaagaagatataaagttttctataatggacaacataaaaattaaaactattcatcagagacatcaaaaattctgaaagcaaataaaaactgaaaaaatgtaagtaccaggtaaagaataatatcctttctccataaaaaagcttataatatacatatatggaaaatataaaaatgtttatgaacagataattcacagaggacaaaacataaaatatatttggctatataataaggaaaaaccaggtcaataggatgcagtgtcatttcttatcaaataagctaagattttgaaacagtgataattcctaatattagcaaatagtaaatgagtaattacctgatgcttggactaccagttgtctcaatgattttctgaggagcaatttgataatacgtatcacattatcaagttgtgaatcatataacacaatatgaatcacatatcacattaaaatgcccacaccaccaattgaataatcccaatctagaagacataatgagaaatcataacaaatatttaggtgaaaaatctcacgacagtattactgtactgaaagactgaaagcaatttcaacacccaagtgtaaggacgtaattaaataagtaataatacggcaatatgatataatttaattgatgtaaaagtccaagcattcaagaatatttaatgacataaaaatgttaatgatagaattctaaatgagaaaaaaaagccatgtaacaggacttatagcttgcacctaattttgtaaaatatatatatacatttagcaaacgtatgagcatatgcatacacatgtgtgtatataaatagtaatctacatatagaaaaacgacttgagaagagttcaactttcaattaaacatcacaaagtaaacacatgcattaacctccattttcttccaaatgcaccaaaatgacagtgtaggaattaaaaagacataaacaaacccatatataccaagagaatggggaaaaaagtgacagcaattgagagatgcaaacattttggaggaagaaaaatggttggacaaatggtaactgattaagcagagcagtgaaaactgaagcccgtatgtccatcaggtaagaaagcagaatacaaccaatttaacccatggagtaccaaaaggacccagaaatggggcaaccagattattctaacggcaggaacacctagggctgaaaacaaaattacctgaaaatctgtataagaaatgttaagacaaccacccacaaaaccccctttgacatctgccatgcgaccagatgccagtcccttctcaatacctacataagactgaaaatgtagttactacaacatatcaagcagagaggatatagcttcaaggattctgtggccagctgagagggggtaagtcaccaggcaaaaccacgggtgatccactgaaaccaacatactgagtgaagacagcatcccccaattagctctgagtacccacagccaggttacacatacttcccatgccttcatgagtgcagaaggcttatctttggaaaaatttaccagatggagaggaaaaggccttagccgtgaacattccaatgttcatccataaaaatccagtttactgtcttatttccatatagtcaaacctgtcagtgaacaaagcccctcccatgcaatacatagactcaaaattttagtgccaatctcttaaatatgaatggatagccaatgatgatgactatttgagttaaatctctaacatgaacagaagagaccaaaacaaacagggaggggaaaagtgcaggtagaaaacaaaagataagtgcttctcagccttttggctaagatcaaatgtagtatctcttcttatcagtttcatatgcagagcagtgacacgataaagcaaccacacaaacaagctggcatgataaccaactaacaacaaaatggcaagatcaaattcacacatatcagtattaactttgaatgtaaatgggctaaatgttccacttaaaaggcacagggtagcaagctggataaaaaagcaagaccaaatggtatgcaatcttcaagagacccatctcacatgcaatgaatggcacacaaaagctcaaaataaagggatgaggaaaatctaccaagcaaatagaaattagaaaaagcaggggttgcaaccctcatttcagacaacacagactttatccagccaaagatcaaaaaagacaaggaaggccattacataattgtaaaggattcaattcaaaaagaagacctaacctaaccctaaatatatacacacccaacacaggagcacctagattcatgaactaagttcttagagacctacaaggagatttcaagttccacacaataatagtgggagactccccactgagagtatcagacagatcattgaggtagaaaattaacaaaattatctaggactttaactcaacattggaccagatggatctgatagacctctacagaactctctaccccaaaacaacagaatatacattcttctcatcaccacatggcacatactttaaaagtgaacacaatatgacataaaacaatcctcagaaaatgcaaaagaaccacaatcattccaaacacactcttagatcacagtgcaataaaaatagaagtcaacactaaaaacattgctcaaaaccatgcaattttatgaaaattaaacaatatgcccctgaataagttttggataaaaaaaagaaattaaggcagacatcaagaagttgtttgaaactaatgagaacaaagatacaacataccagaatctctgggatacagctaaggcagtgttaagagggaaatctatagcactataaatgcccttatgtggtttggctgtgtccccacccaaatctcattgtgaattgtagttctcataatccccacatgtcatgggagggacctggtgggaggtaattaaatcatggtggtggttacctatatgctgccattctcataatagtgtgtgagttctcaagagatctgatggttttaaaggagatggccccctttttcttggcacttctccttaatgtcaccatttgaaaaaggacatgtttgcttccccttccgccattattataagtttcctgaggcatccccagccatgctgaacggtgagtcaactaaacatctttgctttataaattacccagtctcttgtatgtccttatcagcagtgtgagaatggactaatacagtaatttgataccagtagagtagggtgctgctataaggatgtccaaaaatgtggaagctactttggaactgggtaacaggcagagattggaacagtttggaggatttagaagatgacaggaaaatctgggaaagtgcagaatatcctagagacttgttgaattactttgaccagaatgctgatagtcatgtgaacaatgaagtccaggttgagatggtctcagatggagatgaggaacttgttgggaagtggagcaaacgtgacttttgttatgctttagcaaagagactggtggcattttgcccctgccctagagatgtatggaactttgaaactgagagagataatttagggtatccggtagaaaaaatttctaagtggcaaagcattcaagaggaagcagaaaataaaaatttctaaaatttgcagctgacaatgcaatagaaaagaaaaacccattttctggggagaaatccaagcctgctgcagaaatttgcattagtaatgaggagccgaatgttaatcaccaagacaagggggaaaatgtctccagggcacgtgaaagaccttcacagtagcccctcccccagaggactaggaaaaaaaatggctttgtgggccaggcccagggacccctgctgtgggcagcctaggaacttcgtgtcctgaatcccagccactccagtcatggctaaaatgggccaaggtacagctcaggctatggcttaagagggtgcaagtcctgtgccctagcagcttccatgtggtgttgagcctgagggtgcacataagttaagaattgaggcttggaaacctccacctagatttcaaaggatatatggaaacacctggatgtccaggtagaagtttgctgcagtagtggagccctcatagagaacctctgctaggacagtgcagaagggaaatgtggggttagagtctccatacagaatctccactggggcactacctagtggagctgtgagaagagggccacagtcctccagaccccagaatgttagatccactgacagcttgcaccatgtgcctggaaaaatcacaggcactccacacaagcccatgaaagcatccagaaggggggctataccatgcaaagccatagggaccaagctgcccaaggccatgggcacccatctcttccatcagcatgacctgtatgtgagacacggagtcaaagtagattattttggagctttaagatttaattactgcctgattctagatttgcatggggcctgtagcccctttgttttggccaacatctcccatttggaatgggtgtatttacccaatgcccgtacctccactgtatctgggaagtaactaatttacttttgattttacaggctcataggtggaagggactcacctcatctcagacaaaactctggacttggactattgagttaatgctggaatgagataagactttgggggactgttagaaggccatgattggccaggcgcagtggctcacaccagcaatcccagcactttgagaggccaaggtgggtggatcacctgaggtcaggagttcaaaaccagcctgaccaacatggtgaaaccccatctctactaaaaatacaaaattagctggttgtgggtggcacatgcctgtaatcagagctgaactgaaggaaatggaggcatgaaaaacattcaaaagatcaatgaatccaggagttggttttttgaaaaagttaataaaatagactaataaataaacaagaagagagagtagatccaaataaatccaattagaaatgacagaggggatattaccattgactccacagaaataaaaattatccttagaaactaccatgaacacctctatgcccacaaactagaaaacctagaagagctgaacacatttgtggacatatacaccttccaaagactgaaccaggaagaagtttattcccgaacagaccaataatgagctctgaaattgaattggtaataaatagtctaccaatcaaaacaagcccaggaccagaaggattcacagctgaatactaccagatgtacaatgaagatctggtacccttcctaccgaaactattccaaaaaattgaggaggatagactcctccccaactcattccatgaggccaacatcatcctgatacaaaaacctggcagagacacaacaaaaaaagaaacttcaggccaatatccttgaagaacattaatgcaaaaattctcagcaaaatacttgcaaaccaaatccagcaaaacatcacaaactaatctaccatgatcaagttggcttcattgcaaggatgcaagtggttggttcaacatgtgcaaatcaataaacgtgattcatcacacaaacagaactaaagacaaaagccacatgattatctctatagatgcagacgaggctttcaataaaattcaatatcgcttcatgttaaaaactttcaatacactacgtattcaaagaacatatctcaaaatagtaagagccatctatgacaaacacacagccaacatcatatggaatggggaaaagctggaagcattcccattaaaaccagtacacaacagggatgctctctctcaccactcctattcaacatagcattggaagccctggccaaagcaataagccaagaggaagaaataaagggcatccaaatagtaagataggaagtcaaactccccctgtttgcatacaacatgattttatatctatataaatcaggatacaaaatcagtgtatgaaaatcactagcatttctatacaccaacaacagccaagctgagtgccaaatcagaagcacaataccattcacaattgccacaaaaagaataaaatacctaggaatacagctaaccagggaggtgaaagatctctacaatgagaattatgaaacactgctcgaataaatcagagatgaaacaaacaaatggaaaaacactccatgctcatgataggaagaattaaatcattaaaatggccacactgcccaaagcaacctacagaatctaccaaactaccagtgatgttcttcacagaactagaaaaatctattttaatattcatatggaaccaaaagggcctgaatagcgaaggcaattctaagcaaaaacaacaaagctggaggtatcatattagctgccttcaaaccatactacagggctacagtaaataaaacagcacggtataggtaccaaaacagatctatagaccaatgaaacgtaatagaaagcccagaagtaaggccccacacctacaaccatctgattttgacaaggctgataaaaacaagcaatggggaaaggactccctgttcaataaatggtactgggataactggctagccatatatagaagattgaaactggaccatttccttataccctatacaaaaatcaactcaagatgaattaaagacttaaatgtaaagccccaaactataaaaaccctagaagacaacctaggcatagggacattctgtacataggaacagcaaagatttcatgacaaagataccaaaagtgattgcaataaaagcaaaaatggagaaatgggatctaattaaacttaacagcttctgcacagcaaaataaactatcaacagagtaaacagacaacctacataatgcgagaaaatgttggcaaactatgcatctgacaacagtataatatccagcatctataaggaacttaaacacatttatgagagaaaaacaatcccattagaaagtgggcaaaggacatgaacagacacttcaaaagaagacatacatgcatccaacaagcacatgaagaaaaactcattatcactgatcattagagaaatgatgcaaataaaaaccacaatgagataccatctcacaccagtaagaatggctattattaaaagtcaaaaaaataacagatgctggcaaggttgcagagaaaagggaatgcttgcacaccgtcggtgagagtgtaaattagttcagccattttggaaaacaatgtggtgattcctcaaagagctaaaaagagaactatcattcgacccagcagtcccattactgggtatacacccaaaggaatataaatcattctaccataaagacacatgcacatgaatgttcatggcagcactattcacaatagcaaagacatgaaatcaacctaagtgccctagattggatgaagaaaatgtggtacatatacaccatggaatacaatgtagccataaaaatgaatgagatcatgtcttgcaggaatatggatggagctgtattctaagcaaactaatgcagaaacagaaaaccaaacaccacatgttctcacttataagtgggagctaaatgatgagaacacatggacacaaagaggggaacaacaggccctgtggcttacttgagggtggagagggagaggagggaggggatcagaaaaaattaactattgggtactgagcttaggacctgggtaacaaaataatcaaaccccacaacacgaatcttcctatataacaaacctgcacacatactcctgaaactaaaagctaaaaaaaaagacattttgaagagcattttttaatgtagagagaagagattttatccaagaaaaagatgctgtaaaaaaggatcattccaagaaccaagataactatcagatgttaaaactatacaagtataaataaaaattgcaatagatggcttagaagatgaagttgaggatattgtccagaatacagaaagaaaaaaaaaaaaagaagaagaagaaggaaaagcaaagaaaaaaaaacaagaaaattgagttttggcttatgtaatccaaaagccaactaataggatttgttaaaaaaaaaaaaaaaaaaaaggccaggcttggtgcctcacacatgtaatctcagtacttcgggagacagaggtgggaggattgtttgagccgaggagtttgagatcagcctgggcaataaaaaactgtgtctctacaaaaatattaaaaatgtagccatgtgtatgtagtcccagctactcaggaggctgaggtgggaggattgcttgaacacaggaggcagaggttgcagtcagccttggctgcaccactacactccaacctggacaacacagtgagaccccgtgccaaagaaagaaaaaaatatacgagagaaaactgagaatatgttatcaaagaaatgatttaagaataatttctagaactgatgataacaaagttgtaaattgaaatagtaaccaaatagtcatgcagtataacttaaaaaaaaacctaaagtcattatgaaacctcaaaacactgaaattaaaagaaaaaaaaaaaaacttggccaagcatgaaggttcatgcttgtaaatgccaacactatgagaggctgagacaagaggatcgcctgagcccaagaatttgagagcagcctggataacatagcgagaccccccatctctgaaaaaataaataaataaataaaataaataaagtggggcatgtgcctatagtctcagctactcagaaggctgaggcaggaggatggattgattgagcccaggagctcaaggatgcagtgagctatgatcacatctctgcactccacactagatgacaaagcgaggccccatctcatttaaggaaaaaaagactaaacatttacaagataaaagcagacatatgtctcatataaaagataaggaatcagaatggcactggacttctcaatattgtgaagggaaatcagaagacaacacagccaacatctgtgaaattctgagggattgacaaagttagaaagataattcagtggagaaaggacaggcttttcaacaaatagtaccagaacaattagacattcacacggagcggggggaagaaaggaggacccttgacctatacctctcactatatgtaaaagtttactcaaaatggaacataaacctaaatgtaaaatataaaatcaaaaacaggaaaaaatctttgtggccttggactaggctaaaaattgttaaataagacacgtcttagtgtcatcatccataaaagtaaaaaactgatgttagacttcatcgaaattaaaatattttgctctgtaaaagatactggtaagagaataaaaagacaagccataggctgggaaaaaaaaattaaaaatcccagatctgacaaaatgcttatatttggatatataaagaactctcaaagcttaataacagctcaattttttaaacgggcaaaaaatttgagcaaacacattactaaagaagatgtacagaaagcaaataagaatatgaaaagatgttcaacatcattactcattaggggaatccaaattaaaatcacaataagacacaactgcacattttgttaggggagctaaaatttaaaacaaaggggaaaaaggaaaaaaaatgctaactgcaggtgaggacgtggaacaaattgaatcctcacctattgctcatgagtatgcaaaatggtacaaccattttgaaaaacagattgacagttccttatgaagtcaaatatacatttatcgtacagctcagaaatcttagtatttactgaaaagaaataaaaacttgcattgagacaaaaaccggtatgctgacatttacagtggatttattcataatcaccaaaaatccgaaacaatgcaaatgttattcaggttgtgggatatgatggggtttctcttccaataatctgatcaatcttttattctttaattcaccgtaccccaccaccctttttccttttcccagatgttaatttctttggagggctgaatctcttctgtatgtactagagtaatggatatatgattctacacatttgtctaaacccataaaactatatatgtgtaccaaaaggagggaaagttactccatgtcaattaaaaaaataattctgagaaaaaattatagcctaccagaactttatatccagccaaactgtcaatcaaatgtaaggataacataaaatgattatctgctaggcaagatatttaaattattttttaccttcaaatataacttttctcaggaagctcctatataccatgctctaatagaatgagaaagtaaaccccacacaaaaaaagaactcatgggacctagaaaaaggagagaggtagcaggaaattccaaaacaagtgatgtgtctgggatctaaagagaacacaggcgatattaaactaggaagctggaggcttctaggcatgtaaattcaaggagagaaaacaatgaaaccaatagatattctgaagaattcagacacaaggagatgagattaacacttttgagggggagttggaaacactttaaggaaaacaaaataataaagcaaggcaggtattatctctatgactggggaaatgaggaaagagatgtaatcacaatatgaggggacttcaaaaggaaacttgggaaggtttgtaagtgaggacgtacaaggaagcttccagagaactcagtagatagatgatatccaaatgaaatagaaaaggactagcagaatgcctattttatttggaaatgtagtattaaacgcagggggaaacagcagcaaaaggagctgagtctggttgcctcaggggggcagagaatgagaggggaagggctactgctgttcactcaaggctttgtagcatacattacttttaaaactgttctagacaagaactttttttcatcaaaaaataagaaaaaagagaatgaatgataccaaattattaacaacgattatttttggttattactgggtttatagataattttcattttattctttacaatttcctatatttcctcaattttctatcttaataatcaacagggagcagaatgagagagatacagacacagagagttattaagagcagaaaatacttctcccttctctttaatcaggcaaagcataatagatatccatgtcttattatgaagacagtctgcatttagaaagtggggatttcagggcacagagtaaaggtttctacgagatagcacgttgggaaggagactagctcagtgcctggcatgaaggaggagtttggatgatgcaaacccctctgtttgcccctggtctaatttttccattggtaagatgagggcttggggtcagccacctctccctagctctagaatttgactccaagaatctgtatccacctcagatgcctgtaatcaaggaacctgccaggaacaggttaccctagcctcctgctgcccaggcctaggtgccaggagcccctcctctccccgcctcccacatagggccaggcatgttcccaccccagaccctccatccactgcaatacattcctgggagtttctttgttctctcaactgcccacctcccaagagacaagtccctgaaaccaggtataaatggctgctgagacttcagtgccaccacctggtctgtgtacttccagctgttgaataaatggcaacccttggacatttctatttcctgcaaagccctcccagattagaagctgatcctcatgactccttacaagcttggcaatgcggaaccaagcagagtatttgaatatgaaaagaaaggccaggtctgtcttgaaattcaagtctctgaactctaagacctggacgcaggccaacacctggtttctagagctgcaagtcagaaatggcaacaaaacacaaggggatgagccgagctttggaaccaaacagccctgggtttgaatccttaatcggccactgaattcctggcactggctgagacacgttttggcagatttctcatccataaaactggaacaacaaggcctactttctatctaaaataattagcaaataattagatgacaataagtcgtgtttactgggcacttgctatgtaacggcactgtgctaagtattttatgttcactgttcatttaatcctcagaaattaactattacgtgctaccatccccatatcaaaaataaggaaattgaggtacagaaagattaatgtgtccagtgtggctcagcaaggaagcaccagagttgggatttgaaccccagcagtctgaggccagacttaactgccgcaccgcatggtttccctaatgacaggcacttcttgagggtggacagtaaccagccctgtctccttcttcctgcccatattatagatgggagaacaaggcccaaagcagggacgtgggcgtcccacagtcatacaggagctgggggtgggccctggattcagctccagttctttcctcatgccagcagccactggagcccacagaggcccatccggaggacccttggatccccactgtgagtgggcccagcaccttgctgcctcagacaacccacaacccctgacactcacaggtcccctcaccttgttctgatgtgggcatggtcttctgctgggaaagcaggtatctggcctccgccacccctcagcacacttaccaggctatcatcctattgtgacacctgccctagtccacacctcttgagagctcatcttttcctccaccatggtgaccaagagcaccacccatgccctgccatcaaagtggagggaaggaccaatctcgggcccctggatccagccaggtctgctgcagtccagtctgctcaaacagctcatgcctaccaaggcaagtgatttgtttccttggtagcatttaacactcactacattaacagtatgtatttattcagggaccatatctgagttatccattgctgggtcctcagagcctattccagtgcttagcaacgaagagtccagttgctacacgcagaacagagtacagaggccaaagggaaacaaaagtccagtgaagagtgactgccaggaaagagatgatggtatcctggtggcaaaggagaaaatagaataatttcagcagacatttaggaggaaaacgggataggattggggactgagggaaagaggggtcaaaggtggctcttggtgttcacatttgcaccctagacagatatccatctgtcctttcggagaagtaagagggaaaaaggaacactttttccaaactgggtggcagctttggagtaccaggccctcacgtaaactgttttgtttgtttgtttgttgagacggagtttcgctcttgttgaacaggttggagtgcagtagcatgatcttggctcactgcaacttctgcctcctgggttcaagcgattctcctgcctcagcctcccgagtagctgggattacaagtgcccaccaccacgccctgctgtttttgtatttttagtagagacagggtttcgccatgttggccaggcttgtcttgaactcatgtgatccatccgcctcagcctcccaaagtgttgggattacagatgtgagtcactgcgctcagcccaaaaactgttgataaaatgaaaccacagataaaaagccagtctgttgcctaaggacaaaccatattatgagcccttgcccctctgggtacccttttaatcagaggctccagactgagctagccaggctggaacggggatctgggaagctggagatttctttcctgagatcaatgaaacactggacattggaggaccagttggggatccctgtattgtatgggcttctgaccaaagggtctacaccatgaccttgctctgtgatcccaccattatcttgggatatctgggctgtaaccaatgggccgctggacagaggagaggatcagaagggttgggatataaaaacaaatcacatcccttccctgattttaaacctgatatgggtgcccacttctctgtggagggtatctccctcatggcagggaatccaaattccaatacaaattggtgacaatctccctttcccattttttcaccaatgtctagtgtagtggccatcattggctgcccgcccagccgtgtcccccgctcatccttcctaggggaacctctggggagtccttgccccctttatataggaacctgtgcttgggcttgggatgatgagacttgaggctcctacacctttggtccccagggttggtccaggaaacaggactcatgtatctcctatcactgcttgccattggctactttaagtatctatctcccctgctggactatgacctcctagaggccagggctcaatatgatccctttctgggctctgcaggagggatctgttgggcagaagaagggcacaggtgctggaggtaggctcttcttgcatacctcgtagggacttccatctcacacggcctccctggttgcccatcagcctttcccaccttgggcaggattctgatccatggctttctttagtctcagagcaaaaagctctctcaatgtcactctgaagctcgggcacacttactctgtgttcactctgttttttttttttttttaaagcgcccttcacatgatctagctctcaggcaaattggaaaaaaagaaaagaaaaagccttaattaaaggaaagtaaggcacagttttcatgcataataagaaatggctttttgagccagcatgataaaatcctaccactctggggttgccctccagaaagtgaggattaagaaagccagggttttatttaagggcagttggagaaataatggcagcaaactcttagaaagcactcactgtgtgccagatattcctacatgctttacaaataagggaaagcagcgattcccttgaatcctgctggccaaaagctgagaagagtgaagagaaaaacatgggtggagaaaaatgaccaaggacatcccaaggtatggcatagtctggagggtcgtgaaagccaactggtgctgttactactgggaactggatcccttgtttaagatctttaataagtggtactctaggttgtggtttgcaaatttgtttttaaatcacctgaagagctttaaaaattctaatagctggggtttacccgctgagatcctaatgaagttagactggggtgtagccaggacaatgagactttttagacaaaccccaggagatcccaacgccagtggaggttgtataccctggcctaatgttgtttactagtatattggtttcctcagctgccgtaacacagtaccacaaactgggtgacttaatgcagaaatttattgtttcatactattgggggccagaaacctgaaagcatggtgttggcaggaccatgttccctctgaaacctatagggaagaatctttccttgcctcctcctaacttctcgtggtttgctggtaatccctggcattacttggtttacagctgcgtgacccccatctctgcctgcgttgtcacgtttttctccatgtgtgtctgtgtcatctcagggtcaccttcttgcaaagatactgattggggccaacctactccagtatgacttaactaattacatctgcaatgacggtatttccaaataaggtcacaatctgaggtattggtatttaaggcttcaacacatcttttttgtttttttatttttattttcatttttttggtgtgtgacactgagtctcactctgttgtccaggctggagtgcaatggtgcgatcttggctcactgcaacctccgcctcctgggttcaagcaattctcctgcgtcagcctccctagtagctgggattacaggcatgcaccaccaagctcagctaatttttgtaattttagtagagacggggtttcaccatgttggccaggctggtctcaaactcttgacctcaagtgatctgcccatcttggcctcccaaagtgctgggattacaggcacgagccaccatgtccagccatcacatcttttttagagagacacaattcaactcacaacaatgggtataaatgcctgttcctgcaacccctcagctttgacctgtggactctgcctgcccattgcctgaatgccatactcacagcatgagttgctacttggagcccagcatccccacatatttgggagatccctagtggccttcctgctcaagaagcctctacctttctccttattgttcatggagtccttcgtgctacttgactcaaagccttttgccttggctcacttggcctttggcttctgagtcttcaacaccaggctccttggcaaggctactgacagcctgctaaatttcccaagcacccttgccatgagaggtatgctacaccctgtcccctcaaaaccccactgctagctggggctcagccacaaagcagatatcccaccccatccagctgcaggtttggtacttgcctcctcttaggtagcatcagagctccgacattccactcaccaggaacaaggcccactaatgagtcaaagctcctttaaaatctgcatttgtctggaccttgctgtgctattacacagctgaacatccttgggcaaatcacttaacctctctgaagctctgtttccccacctttaaaacacagatgataatccatgccctcatttctgatcacaacactcaggacaaacacagctcagaattcagaacagtttgggtttttagacaagtaatatgggcccataaaacagtcctagtgagatctggggcaacattctgggctcagacacacaaatatttccacagtgaggcatatcaaaattcataccatgggagacaaaggctacagatagcttcataacagtttgcgtcaggtttgacagccaaatgaatttagtgttaaatacacacacacacacacacacacacacacacacacacacacacacacacataatctctctctccattttcataacttcttgaatttctggactatatgtacgagaatgtcaacctaagtctagttcacaagtttgtggtaactattacaagagatatatcacacatgtgggtatcttgcagaatagctagtttgaagtaattaagtatttgtgaatctggaaaaggaaaaaagcttcaatctagctgaagccaaagtttgccactctccttaaaacactgcaatttggccagaaggcctgtgacttgtgcattataagtggtaaaatgtccccagctttgccctgctccccacttcatcatcagtcccaaactgaggtctcagcatgtgacaggaaccacgttcattctaatcatcacagtaatttttaaaaaaaattccagctccattccacatctcttaagttttggcataaatcattgttacaagaagaccttctcttagaaagatctttagaatcagaaaactcctgtattctccaacagcagcctggtttcatggaatgcagccagactcaggttcacaggtcttcctcctcaggttggaagtggtttttatggtggctgcactgcgaacatccccaaagctccaggagacatgcaaaacgaagaagagtgcagtgtctacaaatcagcagccagtgctacaagggagctgagtagctacactctgtcaggccagggttggaaaatccattgtcttcttcacttcagactgctataacaaaatgccttagactgtttatttatttttatttttattatgttttttgagacagtcttgctctgtcactcaggctatagagcattggcacaatctcagctcactgcaacctctgccccccagattcaagcaattctcctgcctccgccccccgagtagctgggattacagaagtgcaccaccatgcccaacaaatttttgtatttttagtagagatggggtttcaccatgttggctagtatggtcttgaactcctgacctcaagtaatctgcccactttcgcctctaaaagtgctggtattacaggcatgagccactgagcctggcctaaatttattgatcatagttcttgaggctgaaaagtcaaagatcaaggtggtggcaggttccatgtctgatgaaggcctcttcttcatgcatggcagcttctatgtgccctcacgtagcagcaggaacagagggggtccctcaagcctcttttataaggacacaaatcccattcacaagggctccaccctcatgacttaatcacctcctaaaagccccgcttcttaaaattatcacattggggattcggtggcaacatacgaatttggaagagggagatacgaacacctagaccacagaacccatctagtcaggcctagtatgaccttggataagctaattcacttccgggatccctaaatcttcacctgctaaataagcatgtggattatattcccttccaaggaacttctggcttaaaaactccacaattaagatttctgcctgtctgagataaatgttggttccctaaagagatttggaaaataaactatagctattaatagcttccgatagacaatttcaggcaggaggtaaagaagcaattacacagtgcacatctcatgccacacccggccttcgtatgctgatggattcaggtacagtgtggttctgcagttcccttggggaattttgtttctcaaagccagggactgactgctcccaccacggcctctgctgggcagctgctactaggcaggaacctgtcagaaatcaacccaagcaatgacttcttttgggaaacagagtctccagaatttgaggtaattcaggtaaatgtggcagatggtagcatctcaaattgtcatttctccaaagaaacctggcaagggtgataacctctggtggcctgaatttagagttgagcaatagtaagaatatggcaggtgtaataggttgctattgaggggagcagaaagatttggggcagagcactccctcaggtatacaaagaacaggggccatgcccatggttgtagctttggctccaaggaggaaagtaagcatggagggcttccaaattggactaaagccatctctggctgaattctgggtgccacattctaatgagagggaattaaggggtaagacttgacctcatgtcatctctttacagtgaccttaaaaagcacatcaccttccttaggagtaaaattctattagtagaaccagccaggaaaaaataatgcatgcgagtgtgttgcatggaaaatctcagaaacttggccaagaaaactgaaagatcaagaacctgagtaaaattcatcgtaacaatagaagataatgagaaaaaacacaaaacttcaaaataaagtagttaagtgtatgtattgaggacatgggaacaacatttacgcaggtgagcatcagagaaggaaaggcctgttttttgaatgccaactatgtgccaggcactgtgctaggcactttccattcattatttcacttcactcccataaaatacatatgaagtagcattggcggtcattgcagtcacagtaataataggaaagcaccagtaattagaaatcatagtgtttttcaaatctttttgtgatgaaaacataccccgggttcagggaggcaagcctaccaaattcaaaaggcatgaagagaaaaatgagaactcctataaactcatctttagatatgagcctgatgccaaagctcccaccgccatagcatccacattaccatcagaattaaggggtcctttctatgagagtcatagtccttgctcaggtgatttcattggtttccaggaccaggatttcagaaatgacaatggatttttttttcttcatggtccagaaagtcttggtcaaaaaaacaatttggttactcacagtgacagaaggcccctggctggggctctcagagggaatccatgctgaccactccccatgacttcccccacatgacaatgggctaagtggggctctcatgcttcccttctgacccctctcccctctcctgactcaccaaaaatacaaagtccttgggtaccttcaacatatctagaatcagcttcacactgctctggcgtttgttcattcatcagttcgagcccctgttttgggtcagaccccatgctaggagatgggcgtacggggatttggcaagctgcctagtctggaggaaacccatggtccctgcctgccattccatgactctctatcccacccacctgttcaggttcattctcccagcaccttctgccaatgtgacaatagagtttgcggtctccaagaaccagccctctgggagtggctagtgctttgcttgacggggaccatcagattcagctctcatcccttgttactatgaaggtaaggatgaagatgcccctgtgggagaagggggctgcctaagaccaaagtgtctagacattggtaagcaagcagcccacccctcccttgcctgagtgtgtgaatgtactcaggatcctcggagcagtcagaccagtgccttgctcgatgtccactgttgtttctgtttcgggtgttcttgcccctcagaggtccagactggggaaagctaaagggctgtcttgtgtggtaatggccaagtcacttctcctggatctcaactgccttctctgtaaaatgggagtgttatattggttggtgatccaaggtcatcttttccatatatgcaggtttatgattttatataaacctgtttctcatcctaaatcataattataatcataaattgaagggcgtgcatgtgtttctgtgtgtgcacatgtgtgtgacagagtgtgtggtctgagaaaaatctgactctgagttttctacgaatgctccagagagtacttaaaaaagtctggaatcctggactctccttgttgagagggcacacacctgctatacccacgtgggtcacacagcccacctgctgcacaagcaatggaggaagggcatggcagagaactccctgggtatgagctggatgcaggagtccaagacaggcatgaacagagctctgtgatctggtctggagaaatgggacatgtatggagcacttggttaagggcaagcgagattatcccagaacacctcaggaaatcagagatagcacaagcttctgagaaatgatggcagagaagaactgggcaggtaaagaatcagacctccagctggtccagggctcagggttaaacccaggggtgccctcaaagaacagacaaaatccttgttctcagtcatgagacagccacacctacttggcccagcataggtctattaaagacagaacttgcaggggtctgcaagggaagctgagcatcctgcagcccccagggacgctacaaggcagctgagggcctcaaaaccttaccaccatcacgcccaccacccaccagcctccgtgtgtcacccagaaccatggatgccctcacttgctgcctgctcacttctcctactttgataaggtcactcgccatgctttataacgcaaaaataatattcctgctgccattgcaaattatgtctgaactatccacccttcccatcctcatgcagaaagcagctctgcaggggagaggcatgccgggctgcagttacaaggcttattaagacacctaatggaacaccttgtggtgaccgccccctctgaggagagctcagcaaaatgcatcacagaagcagatgtcaggcttaaggcaaaagcttccaaagcactaaagccatacatggaaggactgagactggccccatctgtaccagatgttcgccatggctgtggtgctggggctcctcacccttcataagcaaactaccacagtaatgatctcacattcttggcttctaggggctgcaagaagaggcactcttgcttaatacaaagcttgggacaatggctacaggcatttggtgagcctcaaacaccataggggataaagttttaatttaagtgaatgagttgcaagcccagctgtctggggaatgacctctttagggttctcttcgctgcccctcaggagctctggtttcccatgtggctagttggctcctaccttctgaagtggggagctctggaaagttgagataaggactgggcctggggacagaggttccaagaaggctacagagcctgattttttcctttgttttcctgtgtcttaggtctccctcgaaaagaatcaatggaagtaggtaccctagtgctgtggtagaaaatgtgcaggaacaagccagatgcaaactctgtctctactccttacaaacaatgagactctggagaaaacaatggggccattctatgcctgtgttttctcattttaaaaatgagggtggtgataataacagtctccttgtcctccagtttttatgaagatcaaattagttaatgcctagagaatcaatcagggtcaccctgggcatgttcgaatgaggagaatccaaggcaagttaacaaagggaatatttacaaaggtacaaagcgggcaaggacaagggtaagtgtagcagagcacccacggggatggaagggattaggggaggaagtcgttaacagaagccagcaggagagaacaggggcgagaagatccccttgagaggaacagcaaccttcagtcaagacacacggctggcccatagcaaccacacagggaaggcccagggaataagtacacagaacactcttactccccgcccccctctgatttctggccatacagaagaccaagggcattggcagagcctatacaggccagcctttcagggcagtgagcagggtggaggtgggtaaagatggattgaaagggtcgcgtgaacaccactagcacagctctcaatctgcccaggaagtaagcactcaaggcacgagatgttgctccatccatgggcatcaacttggatatacatgttcagccctcatcactgggacactaaatggggctttagagtcacatgccacagccatcaatgtctctcacagacctgtagctgccacagttgagtgatctgctggctgaagggaaggccacccacaggtgacactcccaggacttccctgggcctaccatgttcaccttgagactgtttagactttgcatcaatgacagggcaagaggcagtgatgtttccatcctgttagaaaacagaggtctttaaaaaattttttccataggtttttggaaaacaggtggtatttgggtacatgactaagttatatagtggtgatttctgagagtttggtgtacccatcaccctagcagtatacaccgtacccaatttgtagtattttatccctcacccccctcccaccctttccccgagtccccaaagtcattgtgtcattcttatgcctttgcatcctcagagcttagctcccacttatgagggagaatatatgatgtttggttttccactcctgagttccttcacttaggataatggtctccaattccatctaggtcactgcaaatgccattattttgttcctttttatggctgggtaatattccatggcatatacatgccataatttcttcatccacttgttgattgatggagtttagggctggtttcctatttttggaattacaaattgtgctgcatgtgtgtgcaagtatcttttttgtataatcacttcttttcctttgggtagatacccagtagtgggattgctggatcaaatggttgttcttttagctctttaaggaacctccacactgttttgtatagtggttgtactagtttacattcccaccagcagtgtaaagtgttcccttttcaccacatccccaccaacatctattattttttgattttctgattatggccattcttgcaggaggagtaaagtggtaacacactgtggttttgatttgcatttcccttatcattagtgatgttgagcattttttcatatgtttgttggccatttgtatatcttcttttgagaattgtctattcatgttcttagcccactttttgttgggatttttttttctaatttgagttcctcgtagattctggatattggtcctttgttggatgtatagatggcaaaatttctctcccattttgtggactgtctgtttattctgctgattgtttctttggctgttcggaagcttttcagtttaattaagtcccatctatttatctttgtttttgtcgaatttgcttttgggttcttggtcatgaagtctttgcttaagccaatgtctagaagggttttttccgatgttatcttctagaatttttatggtttctgatgttagatttaagtccttgttccattgtgagttgatttttgtataaggtgagagatgaggatccagtttcattctcctacatgtggcttgccagttatcccagcaccatttgttgaatagggtgtcctttccccactttatgtttttgtttgctttgttgaagatcaggctgtaagtatttgggcttatttctgagttctctattctgttccactggtctatgtgcctgtttttataccagtacccatgctgaggaaacaggggtctttctgacagccaaggggtaagtggaatttgctaagtgaaagaggtccattttaggaagtcccactttctcttaaatgacaaccagcctcctcctaagtctttcccacttgctctaggcctgaattcagagttccattgttctttcacagaactccttggagtgacaatcaactaaattaaatcaattaatccaacatttacagaaagtcaggcatgtactgcttctggggaaagtggaaacagatcagatgcaggcactgtccagtggtttctttttcccaagaggacaattttgaaactccctcctcacatgcccctagggtagccaaaacccatagaggttcattctccaagatagggtggtacagtgggcagagcatcagccctgggggccacaacacactctgttagaacccagctccattattattacatcatcttggggaaaagtcacttagactccatgaaccttgttttcctcctctgaatctttcagagaataatctctaactcacacgatcactctagggattacatgagacgatgtgtgtgaattttctagaacagcacccaacacacagtaagtcctcaataaatgttagctcttcacccctacaagaactccaggtctccagatgcctatgtctacccctttaaatctcagacttagaggaagttaatcctgctgtttctgtttcctacaacttgggctgtgctaccttgtcccatttccttctgggtccaggtttcatcacctattaaatggaaggacacagattacacaatggataagccaaggggttctcaactttccctatgactacatttctccctgggctgcatgttatgaaaggcttgtccactgcataaactgaatttgtgaaggactacctcttcctccattttctcctaatcaaagcaagttccccccttcaggtttctgagcagcatgagatcacagctttgttcaccgggttgaatttgaaacctaacccaaagaacttgagatttctttgaacctgtatagtgtaggcacaggcatcttgaaatactaaaagcgcttcaagcactaccacttctccttcccagattcccaggtcctcaagttgaaaagcactggactaattgattcttctgaagccctccaattactaactctgtcattttaacgtccgaaccggaataactaaggaaaatcaggcccaacctgaaaaggcatttgttaacatgagatggactgtggctcattatggcaagggctggatatgtaaggatggaggcattttatttatgttaggagactgggccattaaccagtgttgtgaatgtgccttctacaggcgagtcttttggcatcccccagtggtaggcagtcagtcctttttgttcagttgctatacacccactgcactgcagtgtcaaccccaaaggcagtggcacttacacattcctttgtgaggccagctgctggtttaacccatggccaggcctggtcctttttctccaagcaacagggaaggtgcttagaggcccatgggcttatctgcaaagctattttcctggagctcactttggagcatcccctcctgaccatggtagtgatttgagatcaggtgtcttcaaagagcagcccttggaccagtctacctcctgacgccctttcttctcatcagatggaaaactcacagatgggaaaaaacaagctgattacccgggtctcactccccacagacatcttccatctttggtcctcattagggctcttggtagctggctcgttgctaagtcaaacttgcaaggcacagtttttctgccacttctttagatctgcacttaattacagctgttccttcctgttggccattctccactgtttcaaacatccaagatactagtcttctaatgttcttatcctctcattagagttgaacattttgttcttgtcttacatctattctgttccctgcacagctcaagaagtacttgagtttttgcctctgcttttatgttgcataataaatagcattctgcctggtgtgacactgagaataactgagttactactttctatcaaaagtatctaaagatccatgaagactcacaaggctcctttctgctgttaaaagactgtgcttttaacaacgctgatttctattattcttaactttattaactctaatcttactcaactctaatcatcactgtcttgcatttctccctttccaatccaattcttgatccattataggcatctataattataatacctccctgcctacctggggtattccttttactctcaaaaatgtccctattgaaacaaaaataaatatgtcaccccaaccatagagaataagatgtttcctgtttatttgctattgcttcagctcaagttcctgctctccatgtgtcaaagcaggggtcagcaaatatttttcgtaaagagctagatagtaaatacttttggctttgcaaccatatcgtctcttttgcaactactcagttctgccatggtggtgcaacagcagccgcaagcaatacgtaaatgaatgggtgtggctatgtttcaatacatttaatttacaaaacaagcagcaaaccagatttggcctgtacaccatagtttgcaatctatgcttatgtacggactgagataatgatctgcctttccctctaaaaagctgattttcctaacagcattaattatataatctattatttcccaaaacgatttaagtctaccattatcacatagtaagtatttacatagacacaaatcattttcattatcttattttgtattctgtttcaattacattttatttcactagccactaaattgcttatagtattaagttattttataactctctgtaactttttgctgtgcaaatctcccttctattaagggacaaaatgtcccttttgccattcttatgcatttcatcttctatccaaactttacaatcatttttgtcaagttttaaaaacataaatatgtaatcactttgggggagaattgacatatttatatgaatacacgtttccattcagaaacatgatatttttccaagtattcaagtcttcttttatgtgcctctgtgttaaagttttcatgttgttcctgcattttttttatcttcatcccaagctttaaaagatattctgtcctgttatgattgggtttttctttgctctatatattacaatttaaaaactgcacatagaaaaaacctgctaatttttttttagaaatttatttcgtatctggtccctaaaacctcttgctaatgccaatgggttcttctttgatgcctccttcatatatttttttagaatactaatcacacttgttcagagggctatgtcctttgattttcagagccagagtattttttcttttccatcagtttgaggatttttctccactggctcatcctagagatacagccttcattcatggattctgttccccaccaagcccagcctagatacctcctctatttcacaaaccctctcatctgacctatcaacatgccttctagttagtgaggcttgtactaattttacagtgcttgggtgcagaagagaacagactgagaggtaggtggggctgcagaaacccactgggaaacctagacctccctagagagtgaacacaagttcactcagagtggccaagagaatatgacaaatgcaggttccacccaggttgctagcatacttgaggagtcaaagatggtggtggagctgcccagcaaagatgttcaagtgaaggcatcaggagatggggatgctgagagtcagaagctagatgatgaagcaacagctttgctgcatttcaggataagagcaaagaagctaaatctcaggcaccctttggtctgatatatctacattaactcagcattgtcagtgccttttagctcatgtggcttggccctgagtattttggtctcattcaggaatcaccatcttaatcaagaaaactaagcagaagcctcatatgaagaactttgtattagttaaggttctccagagaaatagaaccgacagaatatataaagatatataagaggagacttatggaaattggctcatgcaattatggaggccaggaagtcccccagtatgctgtctgcaagctggagaatcaggaaagccagtggtataatttagttcaagtcctaaagcctgagaactagaagaggtgatggctgatggtataactctcagtctgaggccaaagtcctgagaacccaggatgagaaggtgtaagtctggaagtctgatagcccaacaaccagaagctccaatgcccatgcataggagaagagtcctagctcaagaaaagagagaaaaaatgaactcctctgcccttttgttctattctggtgctcgaacgattggattaagcttgcccacattggtagacttctttactaagtcttctgattcaaatgctaatctcatctagaaacaccctcacaggcacacccaaaattaatgttttaccagatatctgagcatcccttagaccaatcaatttaacactcagaattaaccatcacaaccttgtatacgttttcctcagaatgactgcatgccaggattgcgccagcaggctgactttaatcactactatcttgagagatgggctcctaaaatacagcaaagttgagctggatctgaatagactaaccccgtggctgagcaaatctgggcaggaccagatggaaaatgggctaattctgtaccacccattatcaaatcacatatatgtctagatctgtgtcaacaaatcctttccaacccaccaaatcaaatcattggagtagaactggggagacctgcagtaccattacggctcacaatacctcgtcacaacatgactctggatctccttatacccagagtgtttctgtctggagagtaggatgtaatggtgacattccatcttcctttccatacgtacccatttgtttccttttatttgttcattcattcgttcatttggcaaatacttaccaagcctactgtctggcaggcaccttactaggtactgaaaatagagacaggaataaggaactctatccttgaagcacacatcctattcacgcatggtttaaggaggccaagacatagcaagtttgaacaccttgacaaaggaaagaaactagggaggtacaaccagagtttaatcaaggactgtttaacttaccacacctgctatcactcagaattctcacaggaagcttccctaggcacactgtgacagaatgggtgggggaaactcttcctaacaccacctgacatgtgccttgcacccaccacaggcatggtaccttgaagcagagtaacagaccagtcagatgatcacatctccctcacctatagagactcatgatgatgtcttactgcctaggaaacagtacagtagctaaagcaatcactgggggaaaaaattctgaaatctctaagcattgctcattagcataaagcttggagaggtctgataaagttcatggcttatctccaagcctgcttgcttcctctctgcccagagcagcagctgggcaagggattgccttctttgcaaagaagcaaattaaattaaattagatcagttataccagcaccaccaacagcagaagcatcttcaataaaattaagatctcgaaatgaaaacaaggaaatcatcttctaaaaacctaatcccattgcccagtttgaaggcgctcactactgagacctcctgtggcaactttacatgaacatttgggagcagggaactaggggagacctggcagcatcgttgggtaacccaggatctgggccttttgtttgttgttgttttagtcttagggaagcacatatccaatcacacacttgatatataaataggccatttcagtgaatacagtcattggaaaccttttccaataagagcatgtcatactggctatgaaagagtgtatttataatcacacagcatggtatagtggaaagaatgccaggtattccagaaaatatggtggtttgcacaccatttcacagaacctccatcttcaaagttgactgaaatgaacaaaatgaattaaaatgaacaacaaaaatattattaattctgaaactcagaaactgccccaacctcatgctataggttttaagtgccacctgggccaaaatgaaagaagagtaatctatgttcatgcttttttttttttttttttttttggagacagagtctcactccacccaggctggagtgctgtggtacaatctcggctcactgcaacctccacctcctgggttcaagggattctcatgcctcagcctcccaagtagctgggatcacaggagtgcgccaccacacccagctgatttttgtatttttagtagagacatggtttcgccatgttggccaggcttgtctagaactcttgacctcaagcaatctgaccacctcagcctcccaaagtgctggtattacaggcatgagccatcgaacccagcccatcctccctttcaagatggaaaagtactgttggcaaggaaaaaaaaaatgtgtaatggacagaaaagctgaatgatatagctcctaatttgaagagaacaaattggaaaggtgtgaatattccacttggagctcgtttttcccattttggattgactccttccctaaatcccttcccagagccattctgggaattatcaggcagaaaccagttatctcatatgaggactcaaatgggcaaagacaagaaaatgaatgggtttagaaaaacaaacgacaaaagtccatgaaacagaaggacctctcattaaagcagctgactcattttgaaacaggtgagcaaactgaagctttaggggaccacccaccccaggaagaggatcaactgacaattcaatagacctaaatctagtgtcagaatttcaataaatttagagacagattagagacaaagcccccagaggctttttgcaagtcctcagcaatttcctctcccataagagagcagtcaaactgtaaccaagtaaattgggaaaatagcaaaggcaaattcagcattaccaatttggatcaaataacaccatcaggtaactgcccccactgatatagtggtcaagtagagggggaaaagtacaagacttaaaggaagattgtgtgtcccccacagtaggtttcacacgcaaagatttttttttaaaactcaccctggaagaagagatgctccaggaaacataaatagatcactgctttgtaatcccaggaaaattaaagagaatttaagctctacgaaacaagcaattaaagggtgagaaaacatgacagttgttcaagaccgggagtgtatcagcttctcgacaacacccccaggttcccccagggttgtcttctgggcaacctcccaggtactgtcctctcatcaatactagatccgctgcagttcctgaacatgtgacggcacagtatgtaaaaatgcatatactattagggctggaggaccctcatctagtcatcgtcaatgacaggacaataaaaaccaagttcacgtatttattaagtggcaaagctatagcttagaccccaacctgaccctacatgtataaagaggaaagaagagggatgaagataggatgttgggagggaaaaaggaggagaaaaaagggagagaaaatggaagatggaagcaacagctggggtgcagtaaaaaggggcactggactagccagaaaacctaccatgaatcaaatctgagtacatgccttcaatttctggggctacatgcccaacaaacagaattgttgggtcacatagtcacttgatgtttaaattttgagaaattgccaactgttttccacattagctgcaccatttggcattcccatcggcaatgtacaaggttctaatctcttagctctagcactcactatgttgcatgactctgaaaaagtcattttatttatctgaacctcactttctttttctctaaagagtaggggttagaactagctatcctgtttctgcctattcacacattctttctttccatccaaatcctgaccttccactgcccacatctgtttccaagagtttcctgacagtgtgaagtactgtaatgagtaagtcctagctctgctccttagagctagaattatcttaatccatatccccaagttatattaatgcacttccatttccatccatatctctcagcgtacattttttctctcttgtctattcttttaacctttttgcaagcatcatcttgttctgtctgtcggctgtcagcttttctctccgagcttctgcggagttgccagattcttgactatttccccaccctcagctcataactgtttttccctggagctcagcgactgctaagtggtctttgtgaaatcctattaggataatctccctgtctgtgtctcctctcagctgggctgcctctagaaacctcagctgtcttcctactcacaatcggcaaatcataggctggctcctgagtcatccaacatcgtacttattcacaaacatgcttagatgagctctgaacctgtcgaatcttgtagcccacaagcaagagttaaattcactggagattcaactcatatgtcttctcctgcagaaggtgtctcctgtttatgcgggacccctattccctctacaatcccaggaatgacacctgccccctttttactttttctgtttctgtttatgtttatcatctatctctctcatcagactgtgagattcatgagagcaaggagctggagtatcttgtccaaagctgtatcctcagtgcctggcatattacaggccctcagtacatgtttgttgaattcatgaatacgtgttcctcttccatagagtcaatcatggatctgcctacctgtctacctattagacccaaagctactttggggcagactgagatttacctgccatggtaacacttgttaaaaataaaattactctgacacttgttaaaatggtaaggaagacattattcaagattattgcaatggaggagagaaattaggcaaatataacaaagacagctggggatttagagccaaggaacagagtgagtggatgaaaaattaccaagaggagacaagggtagggagattcttgctaaaacaacttaccagggttcttaccgaaggcaggccaggatgatcagatagtgctatcatccgaatgtttgtggaggccaaaactcgtatgttgaaacgctaaccgccaaggtgatggtattaagcgatgaggactttggggagatgaattaggtcatgaaggaatgggattagtgtccttataaaagggaccccagagagctgccttgcctcttccatcacatgaggacacaactagaaggtgtcattttttaatgaagagagatctcacgagatatggaatcttctagcaccttgatcttcaacttcccagcctctacaactgtgagcaataaatttctgttgctaagaattagtttatggtacttttttatagaagcccaactggactgacagatgtcaaggggttgggggatcctcagtaggctaacctagcagagttcttgctaaaactgggctagacaggccacagacaagatagccaaaatcaaagcctagttgagaagggaattcagaggagcatgactaaaatttggtcaaggggagagtctttgtcaccccagcacctagcacaagtggttggtactaaatacttactgagcccagctgagcacccaccctcagtgcagccctgcttaccctgacaaaggtttagggctcttactctctcctttgtgcctcaatgagctgcagcgtcaggagaagggactccagtagatagcgttcaagtggctgggggtggggaagagaagcaaaatgtgacaaccccacattaatcaagaaggtacaccattttctcagggtttcataactccaatgatttcctgggccaatcatcccaaatgaccctcacagccactttgtgaagcaagttgatttatcttctcatgttatgaacggaataactgacactctgggaggtcaagcaccatgtcataggtcacacacccagaatttcatgaagtcatgaagacataaagtgtacatttatctgctcagaaactttttaagttgttgtccctaaatattgtaccaacttgtacttataccaacagtgtatggccacctggttgccagaggtctcaccaacactgatgtgtgtctgccggattatttttccttttactgatttttaaaacctctttacatgttaattatatcaatcattttttgcacatataatgcacatatctgagctcagtttgtttatttttttttttaatttttttttttttttgagatggagtctcgctctgtcacccaggctggagtgcagtggcacgatcttggctcactgcaagctccgcctcccaggttcacaccattctcctgcctcagcctcccgagcagctgggactacaggcacctggcaccatggccggctaatttttttttttttgtatttttttagtagagacggggtttcactgtgttagccagaatcgtctctatctcctgacctcgtgatccacccgcctgggcctcctaaagtgctgggattacaggcatgagccaccgtgcccagccagtttgatatggatattttcatgatgtttaggttcttagggacaaagatataatatttttctttatggctgtaccttcaatggtatcatcagaaaactgtcctgctccccaaaattaaatatttatttattctttaaatgtcatctatgttttccaaattttacatttaactgaaatgcactgcatttatccagaatatattttggtacatagtatgaagaacccacatcctcccctggtggattatcatttcatcttgacctgtctcattaattagaaatgtgaagtttgtctataacatgtacacatgcatgcattcacacacacacaaacacacacacacccctctgttttaaggacatactttattctgttaatctatctgtctcttctaagattggtataagctatttgaactattttagtttcaggatatatttctaaaacttggaagtagaagtctttctccatcattctcttttcaacatttgcttgatgatctgtgcccatttatttttccagataaaccttaaaatcattttataacattgcttatacatttctattgcaatatgcattcaatattttaaattgacagctttaaaataccaagccttcccatccagaaatgaaatacctccgtttacttatttgttttcccagttttgctttatagattccttctacagttcctgcaaattgtctcttaagccaattcctcaggcttttatatttgttgcttttacagaatgaatccttttatattatgtttcctaactggtgattggtatttagaaaatttttcatttttgtatatttattccctaactagtcaccttattagactcttttattgggctctaatagtttttcattatttctcttggggttttggtagataataaaatcctctgcaaataataactttatgccataattatatttcccattctgttactagaaatccctgaataaatgttaaataattttagtggtcctgagcatccttatatttttaggatatcagttgttagtttggaatagacaggctccgtcacattaaggaaatagctttctaggtcttttaaggatgacgattattctctgttcctccatcaccactttcacccaccaacctagacatagtggtctgtagtctgtatctcccaggcttccttactctctgcttctagctgagtttaaccaatggcagagtttggccatggacagaagaccagggggtggctgtgttcctctatagcctgtcaagcaatcccttaacactttagcaccatttctatttcctaccattgcccttcagacccagggtggtaatggcttcccaaagttgccagtccctgggtgcttcactatcccttgttaattcccttgattctgatccaatctctatttcattaaaccccatttaaatcattcatctctcacatgcttcttgcctagacattccctaactgattgataaattaagacccagtgggaagtattttcaaatgtatttttcaacatctcaaaataatcaaaatatttttttcttttgtgaaattaacgtgacacttattcattcattcatttaagaaaaaaaattctgagtacctactatgtgttgcttgttgtgctagacactgagatcagaacacattaaaaaaaactaaataaaacaaaacagataagccttctgcccttatgttctcttagggaaaacagttacacaaacatgtagatgaataaaatgccaaatattatgataaggactagaaagagtgtctggataaaacaaaacaaaacaaaacaaaacaaaaaacagggagtacatattcaaaaaggctagtcagagaatactgctcacagaaggtgacatttgagttgagttgacatgcaagctcttgctgagaagagccttcggcaagtgaaaagccttgagacaggagagagcctggtgtggttaaaaaaaaacaaaaaaccaaaaaaaaacagaccagggtatcaccagcaagggggaatgtggcagaggatgtgaataaagagataggcagctgctagatcagcactgtccaacagaaatacaatgcaggccacatttatacttttaaattttctacctgccatattgcaaaaggttatacacacgcacacacacacacacaagacactatcttttcaacatataaacaatataaaaattaacacaacattttacccttttttttggtacaaagacttgaagatctggtgtattttgcatttagagtacatctcagtttgaactggccacatttcaagtgctggaggccactgtattgaaccactcaaggctacatggtgcacatcaggcctggctcacaaggcctcccttggttgagaggggcaagatatctgagactcatctctatagctcccagcatcatgcctggcacatggtaggtgttcagcaaatgtttgccacacaggatggcagaagaactgcaaaatagatggcaagttcctgaagcagagaggctgcaccaggatcactctggtgcctgctccaggaaattgggtctattgtgtgtcctcaagcaagagaggaagttggggtccacctgctgagtctcccactgtgggggctgttcatgaccacctctcccatagccagggtgcttggcaaagctgctttcttaattcagaaagatcacatcacaccatatgccagagagtgggagggagggagcccattagcattcattgtacacagcttttcgtttggaaaagcacctcgaatgtgccgatctgcattgctttgcttcatttttcaacattcatgagtgtaattgcatttatttttctcgtcaagactgcaaaacaagtgataatttactacattacagcccatatcggctgggtttacagccacaacagttataatccaccctcttagggactgggtgggtaagcagggggtggtctttttagctgagagcactgtatttctttataacaggaagcttgggcccagctgttcttcaaggttacaataatagtggcaaaaactaacccatacagagacactgagctgtcaaagcatatgcacttctactatcttgatggcttcttacactaatggggtaaggcagacttgtactcccattcacacttgccagagaaagagactgagattcagagaagtcctctgtagtagatggtaacaggttggtgaacagcagagccagggttcaaacctagattcatgtgataggaaatcccgtgctctcctcatgatgacacctggcagtgcctgagctctagcaaagcgtgaggtcttgtagttatattggtagaaaagaagaggacatgatcttaaaattttgtaaatgtgaatgaagtgcctacagcagctgtgaccacgaaggacacctattttcttgcatctacaccacagaatgctaacttccagcagagaatcaggacaggagactacatccctgcctgaggtccatccaggtgctactctgtttgtgactatctagaaatgagagcagggaaggatggtctagccttgtatttggagatcattcaatgcagatgttttcttcctctttagaacaagagtcaagccatagtgatgttcagactttagatcacaaatgctcacgaattcatgagtagtaactgatgaacaagatccaaccctaaaaacttatggattcattaaaatcatttcctaagtaagattaaagtagtggacatgtcagtggtcgtgagctcctcatttcttcttcctgggttttagagggatgtaaactccatcccctaacctgactccctgccccctaattacaacacacggatcttgaaaagggtggacttgaaagctggtcttgctgtaaaggatctgaggaaagtgggcagaccatgaaaagccccagatctcagtcagaggatattgctaccatatgatgtgacatctctttcaagaggagatgaccctggggtccagccccacctctgcagctttctccaaggcaggaaagagataccaggggtccctgtaaagtctgaagagtcaggagctgacaggtgttcaggaagtcgctccagctacctggccaggatgctgtagtctgcaaaggacccttcagccctgttcctgtcccttttctgcaaactgaggtcccctctctcaatcaagtgatggctctcctctatccactcctgacattggcaagtgagaccctgtgtgggcgtttctgccccaggccaggactaaaatgacaaggtctggccactccagggccttctgctgagtctcagtaagcacacactggacaaagaacctccagcagccactcaatataaggggcctcaggtcttcaaagaaggccagtaggcgatgatgaacattacagcccacctagtgttaaacacatgtaatcacacacacagagagaggaggggagaggggagagaggagagggatggcaggcctaacaagtcctcagggttttccatcagtacacaggttaccaaggcacctccatgctgagtcccagctctgagacaggacaagaagaagctgcttgatggtgatggaggagacccaacatgggtccacgcaccaaacattttgttctgtgtgttctcaaatgtttgtcattcaatccctatgtgtcccaattgcatgaccttcattttataagtaagagaaaaccttgagccatagagaaactttgctcaatagctttgctcaaggtcccccacactagtccctctggctatagtgtccctgaaccttgaacgtgtatatgcctctggaatctcttttctgaaattcaactgtacagagaatcaaagaccaaggttatcaaagttttatttcaaacacaggaaagtagtctttcaattcaggcaataacctttctgttattattttccatattgcaaagtctaaaaacttagcacaaatctaaaaatcaggcttgtaaaggtgacattttgtttgaaatggtcaaaatcagataattttttcaatcagcatggagtgttaaattcaggctttcttctacttgttgccatcacccagaaaagaaaaataagatttattttccagaggttggaactatactccaggtggctctctggcctgccaggccccatctgctccatgctgctaccacctccacgtgcagtcaagactctcttcattcctgtattgtgaagtcttttcatgtggtccctggttgcagtaatgaacaaagtatgccacagcagaactgctttatagaacctgtgtggtattagagttagaaaactgggagtattacctaatcagggctcttccttgtataggttaaggccactggagcccagagagactaagcaacttgcttcaggccacacagcaggtcagcagcacagcagacccggatctcctgagacccactgagcaccatgctctgaaccacaagtgtatgtttcagccacctcagattttctgtttcctttaaatctgtttccaaatagctgaacacttcactcatcccctaactcacttattcaatattcattgagggcattctggtgccagttttaggagctgaggacacatagctgtgaatggaaaagttgcttcctgctctgatggagcttatagttcattgaggaagatgggtgttaaatgcaaaattacacagagctcctctgtattgagctcccgcactgcctgacctgggacaggggctggaagaacaatgggattctgagacccagtggtctccaaggcaaaggaaagaacatggcagtgatgacaaggggatggcaaagtacagcaggtagaggaagaaactacagggatgcaagcaacagctccaacaaagaggtgtcccagggtgccaattctccgcaggggaaagaagaagggaaggagctgggtgctcctggtggaatgccggcttattcctgtcttcctctaggaatgcactccctccgtctccttctcaggctcccattcctctacccacaccctagattgtggcaatgtgcagagttctgctctctcccctctgctcttccctttctcctgtgaaatcttgaccctggccttgacccctttcctagcttcccaaacacccagtggttctcaagatcaatgtactaaaattgcctgctgtttcctgggccccatcccagtgccacatgttgggataggacccaggaatctgctttttaaaaataccctcggtgattctgatgcagatgttcagtctacctgctcactgagacccaaggtctggtaagcatcaaacactgggccaacactttcacttgctaagaacccagtattgtgggcacagaggtagggtctctgcatgagcatcctggccatttttagcacacctctataggtatgtgtgtaatatacagatgaggaaatggaacccacgtggcttggctagagtcacagaacttcaaagaataggcacctgactccacacccaaatccagtatctttgttcatctctttcaccaagttttcttgagctcaccgatacctccaacccccttttcctcctccccatttttacagctaacatccccattcatgcctgatcagttccctcctggtccactgccttccttcccaccacaggctccctgctgctccaagttgcctttcacactggccaacaagtggttatcctaaaagataaatctgatcaaacattccctgacttaatctctgatgaatcctcactcttatcatgcaacatccttcaagttgtggccccaacctcccttctcatcacatctcatcctatgccacatgaccatggtatcccttcctagaatactacattattcaagagtattggtttgagtatttgcctctgccacttacgtgtgattttagataaaatcacactgccacttctgtgtgattttaaataaattacttaatctttgtgtgcctcatttttctgaactgtaaaatgggctgttaccactagctccttcaaaaggctgttgtaaagacttaataaaagaaagatgacaagtataaagtgctcagcacagtgccatgaaaacagatgctccaaaatgctacctgatactaatgtcatcactgtcatcctaccatgtaaggactacttgttattctctgaacataccacatactttgaggtatctcactggaagtagacacctcttggtgctggaaactcctcatcaaaattctaaagtgactgcaaggtagggtggccataaaatatccattgttgtacaaggtgctttgtatgtgaaattttagttaattccccacataagtcttatgaggctcttgtcccttatcctcattttagagacgagcatgaggctcagacaggttaccaaaccagctccatatcagaatgctagtcactagtagaattggcattccaactaatatcagcctgatttcaatgttcacacttctgttcatttcttctatgtgaaaagaacacagatttttttttttttttttttttttttttactcacttagagtacactgtactgagaattgtgtcatggtatcttgtatcattcctaccctcctaagctcacccacatatcactggggctggaagcctagaaactacatcttactttctggcagggttccagctcagtcttcaccaatgacagaggcaaagactgggccctcaccagacactgagcctgctggcaccttgatcttaaacttggaattcccagcatccagaactatgagacataaatttaaaaatttacatatggccttttttttttttttttttgtgacagagtcactctgtcacccaggctggagtccagaggcactatgtcggctcaccacaacctccacctcccaggtttaagcgattctcctgcatcagcctcccaagaagctgggattacaggtgcctgccaccatatctggctaatttttgtattttcagtagagacgagttttcaccatgttgaccaggctggtctcaaactcctgacctcaggtgatctgcccgccttggcctcccaaagtgctgagattacaggcatgagccactgcacccagcctatgtatcacacattttgtggcattttgttacagcaatatgaatggacaagacggaaattaataccgagaagtagagtgttgtaacaaatacataaaatgtggaagtggctttagaaatgggtaatgagtagaagctggaagactttagagattcatgctgcaaagagtctagattattgtgaacagagtattaagggtgtttctggcaaaggttcaaaagaagaaagctggagagaaaggctcaatcttcttagatattataagtatagtcacaaacagaatgatggtagaaatatggatggtaaaggcaattctgatgaggtctctgacagaaacaagaaataagatattggaaactggaggaaaactcatagtcttcaagatagccaagaacttggctgaatcatgcccatgtctcaatgctttctgaaagggagaacttgcaggtgataaactaggatatctggtgaaagaagtatctaagcaaagtgttgagggtgctacatggcttctcttgactgtttatagtaaaagtgagataagaaatcaattaaagatgaatttataagtaaaagggaagcagagcttaaagattttgaaaattcccagcctggccaggacataaaggtatattatggagagaataccaacagtgtggctgagtcaatgtttgataaaaatattaagatgcctgatagggttattagtatgggtgtaaggaagccagatgctatttatcaagacaatgaaagaatgactccgaaggcatttcaaagatctctaaagttgtcactctcatcacaggcccagaatgccatggcctgggggacaaaactgtatgaaaaaagggatcttgggcacccatgagacctcagcactcgctgctctgtgccacctcaagtctctgcttactgaattctggtgtagtgctccttagatgccccagatgtgactcaagtgagcccaagtgtggctcaggcttcccctccagagggcataaacagtcaaccttggtggcatccacatggtgttgaccctgcaggtgtgcagagtgcataagctgtgggggcatggctacctccacccagatttcaaaagatgccctggagagcctcagtgcccaggcagagaactgccagggtgggtggggctgctctgagaaccctcactagtgcaattccctggagacatgggaattcagccactgcagagaacccctattagggcaatgttccatggagccatggagatgggcaacccttgagacctcagacctgtagagccaccatcacgcaacacaagcctgggagagagacaggcacccaaccccaaccactgagagctgctttgtggggcacgcccagcaaagccatgaagaatggggctgcctgggtctttggcccacccttgctgcacggtgtccaaaaggcaggacgtagagtcaaagaagatcattctcaagcctcgagatttaatgctgtttgtcttcttgtgttttatacttacttgggacctattaccttttcttcttccctatttatctcttttaaaataggaatgtctatcctgtgtttgtcccaacattgtattttggaagtatacaatttgatttcacaggcacacagctggagagcaatttgcctcaagatgaatcatatctaatttagatgacactttggacttacactttaaagctgatacaggagtaagacttctggggctattgagatggaatgaatgtattttgtatatgagaaggacatggattttggggcatctggaggagaacgctgtggcttaagtgcaggtgtacctgcaaaattcacatgttggaacttaaactctaaagtgacagtattacgagttggggcctttagaagatgattaagtaatgcggtcagagccctcatgaatgggaatagcaacattataaaagagctggagggaactaggtaggccctttttgtccttccatgtgacagcatagcattcaagccaccatctttgaaatagaaatggggtcctcatcagacaccaaacataatggtgccttaatcttggacttgtcaacctccagaactgtgagaaacagatttctattattcataaattacccattttgtggtaccttttatagtagcatgaatggtctaagacaccactgaacaattccctatctccctcctctccccagcccctggcaaccatcattctatttttttatttctgtaagtttgactgctctagatacatcacataagtacaatcatacagtacatgttattgatgactgatttatctgtcataacataaggtcttcaaggttcatccatgttgtagcatgtgccaggatttccttccttgttaaggctgagtaatattccattgtatgcgtataccacattttctttatccgtccatctgttgatgaacatttgggttgcttccatctcttggctactgtgaataatgctacaattaacgagtgtgtaaatatattttcaagattctgctttcaattattttagatatactgtcacgtgcagcataatggtgtttccgtcaatgacggactgcacatatgaaggtggtcctaggtggatagttggctatagcttctaggtttacaaaaatacagtctatgatgttcacacaatgatgaaattgcataatgactcatttctcagaatgtattcccatcattaaatgatacatgattctatttcaagaactgggattgctagatcatatggtggttctattttttatttttggttttccatatagactataccatttttacactctcacaaacaatgtacaaaggttccaatttttccagatgcttgacgtttatttctttttgtttgtctttttatagtggccaccctaatgggtgtaaggtgatatctcattgtggttttgatttgtatttctctaatgattagtgatgctaaacatattttcttttcttttttttttttttgagatagaggcttgctctgttacccaggctagagtgcagtggcacaatcttggctcactgcaacctccacctcccgggttcaagtaattctcctgcctcagcctcgtgagtagctgggattacagacacacgccaccatgcctgactaatttttgtattttttgtagagatggggttctcaccatgttggccaggttggtcttgaactcctgacctcaggtgatctgcccacctcggcctcccaaaatgctgggattacaggcatgaaccaccgtgcctggccgtattttcatgtttctcaccatttgtttatcttctttggacaaatgtctatttcagccctttttaaaaaaaaaaaaaaaatcaggttatttgttttgttattgttgagtggtaggcattctttatgtattccagatagtaaccctacaagagaggtttgtaaatattttctcccattccacaggttgtcttttaattctgttccctttgaaacacattagttttaagttagatatagtctcatttgtctatatttgctcttgtcgcctgtacttttggtgttatatccaagaaatcgctgccaaatccaacatcataaaactttctacctacattttcttctaggggttttacagttttcactctcatgtttaggtctttaatccattttgaattaatttttgtgtatggtgtaagttaaggatctgctacatgtggatattcaatttactaaatgccatttgttgaagaaattattctctctccattgtgtagtcttggtacccttagtgaagattatttgaccatgtatgtgagagcttcaaaggttttataaacctctaataccctgtattaaaccccttcctgattgaaatacctagaatggtttccgttttcctacctgaatccaaactgatggacacatcatgcttatatatgtttgcagctatgatttagaaggatcttggaagctataggtcttattttaaccttagacactctcagagttcttaaaagacataacatattcttgcttgttcatagctttcacaagttgtttcattgactacaaggctttgaatcctgagaaagtgcaatttgggtttcttaataaggaaacacaacacctaggaaaggaagcaattttaaaagatattggcagatttgaggaaagttttaaaaacagtttgctcaaatatctgttgctttccaaacataaagtatgatcgtgtcagcacagagcacagtgtcaaaactaggtagatgaagagggaaaacaggaggtctttttagaaaagggtaatttctctcaattaccaaatgtctcactgattagtagttgtggggaaataaattctggagttgtacctgtgaaattaatggggcatgtgatagatcactgcagctctgcaaggatgcgtgagaacagagtacgtgccttaagctcaactgggagatttatctttctgtgaaggtctgggctctcagggatagattgtacgtcaggtgccctacctccatatactcatgaagacaaattcctctgcaaagaagcagaagcagttgccctgcttgacagacagacgaatggaggggttaggaccacaggagtcttcaccaatgttttgttttataaatgtatcactaaattcctatgtttagaaatgccttcttcttgattcataaattacaagtcaaagaatgctagagtcagaagaaactgacttctgatattacaatggtcaataaggtccagggagggatgatgtgtggcccaaggtcacagagcaagttaatggcagagctaggacagaatccaggactccttatttttagatccatttcacagaagtgggtgtaggaagcccagagaaaggcagctcaaagtctgaggttagtgacagatctgggatgagttcccagggatgcttccttagccactaggcagaaggccatgctaaccaaaggcctggcagtagagataatgcctacccaattccaccatgtgcctgcagcccacacagaaccacaataataaccacaggaagaacagagctagaggggcctgaggtagctctgttgttaatatgttctacatatttaaaatcacatgtttccacccaatcctgggtaggaaaactgaggtccagaggttcaagtcaacagagcaaggcagagacagaagtgttatgtccatgtgctaaaaggtggatgcctgggagtcatcagtgggtgccactgacttgagctgctttggttcaaatccccttcccagcacttccaacctctatgatgaagggcaagttgcttaatctcttcgtgcctcaattttccatctataaagtgggaacacatgttacctacactgcatagggttttgtgaaccataaaggaaacaaggctttaaagcacctggcacagaatgagtgctttataaatgctagctattactattctcaaagagagatatccctgttggtgggaatacaagtgacgtcataaaaatctaataatctaggagagtattgaccaatagaaacacaatgtgagccacgtatgcaattctaaattttctaataggcacatttaaaaaggtaaaaaagaaatgggttacttttaataatttatctaacccaatacatctaaaatataatcatttcaacatgtaatcaacataaacattattaataagatgtttttacatgattttttcatactaagtttttgaaatctggtgtgtagtttacacttacaggactagccacatttccagtactccgtagccatgtgcggctaatgaccaccagattagatatggcaaatgggacctcaatggattactggattttccagattgttggactttattttttagagacatctcagccatcttgtttttactaaactggggaaaaaagactatatttatactaaactatttccttttcttaccaaatatcttagaatgcatatttgtaattcaaattactataatagccaaagcataatgaaaacctgtttctttactaaggaaaagacagatcacacatttaaaaatgaaaggttcacttgcaggagctctagcccctgcagcagcccaatcggttgaatggtccacgaagacatcgcctagcatcagcatccagccagcatcaccatgatcaggatgattctcagcaacgtcttcctctccggctgccctgggagtggctaaagttgaagcagcaggaaacagaggaatcttgaagaacgtcatctctgtggtcctgttaaatgtgtcgctgacacacgactgtttttgtgatgcttccttttcaaagaatttactccgaacaacatgcaggttcactgtatctgcatttacagagacactgacagacttagacaattcaacaaactgacaggatcaaccctccattaaaagtaaagcatttcttccatttttccagtgagaagacatcctctcctcaaaaaaaaagttttcgggcaactttaataaatacaattttaagtgtacagatgattgaattaggcaaaagtccacttatggtatctaatatacaatttaattacacatacattttaaaatcacgtttcataaaatattaattgaaaaatagagagtggttcagggcacagattctggatccagacggcctgaattcaaatctcagctcctccatttactgtaactcacttttgagagagttgacattctgggcctcagtttcctcctctttaaaataagggtgataataacatccagctcacagtgttgttgaagtattaaacgatgtaaaaacatgtaaagcccttagaacactgtccaggaagtggtatacacatgttaggttaaaagacatagtggtttattatccattcacatagactttagaacctctttattctttctttctttcttcctttcttttttgagatgaagttttgctttcgttgctcaggctggagggcaatggcgcagtctcagctcactgcaacctctgcctcccagacaacccctttattctaactcgtcaaatgcagcagtgtttgtcatcagaagaagcacttttttagttgaacgatgccagtctccatcactttcacttcccattacaccatttggaatataatactttttgaatctaggtatgatgtcacagaaaactgagtgtcaaggcaagcatctatgtggatattagcacagacaggttttcccatttatctggcagctgtatattctgatcaccaaaaggacatcatgttgcttttcaaagccattgttaggacattgttaggaaacttgttcataaccatcaccaacactcgtcattacttgctcatatcctccggaataattactaaacctgcgttcaatttccttgccttttctatcaattctgtgatccctgtaaacatcccaaactagcactgattggggtcactgcaggctaatgtagtttctacaattaattttgtagctccaagtacacgaaaaaccatcttataatatgagatgttttgtaagaacttttctcagagctgtttggagacaaagatcttgtcttttatttgggcacacagaaggcattctggcatttctttcttctcccacctctatctcttaggtgttagttgaataaaccatggttcattcacccaggagaatatcatgtagccttggaaggtgaaaactaactctgaatacagtggcataaaaagagatggatgacagaagagtttgggagctatgattctattcactgtctacactcctaagtggccacagtgcagctgtccagagcacagcctggaccctttccaagggcacgtcctgcctccaccatatgctaacgatgacctgggcaagtcattcaagttttctgtgcctaggtttcctgatctgtaaaatgcagataacagcatctacatcagaggactgttgcaaagattaaataagttactatatttcaagtacttaggatagtacctgacacatagtaagcactacataggtagtacgtctctattactattaccacatacagatactctctgtcttcctccttccctctctccatcctccttcactctctccctttctctctcaaaacacatcaatatgttaatggtgatatttaggctaactgtaatcagggtggagagaggtaacttatatgttcaaactcagcattttttaagaataaatatataatattttgtcattaaagaggaaagaaaaaaatgtactgactcaacaattgctaaatgggaacataagaacttacaactttaaaccaatcaataataatatcaggtgtgattaaggacacttaaaggcccatacttccatatgattttattgtaagcctcacattaaaggaagagtaggtcaatctgagaatagattacatctttccaagaggagccagttacatgtgtcacaagcagtgccacacattcatgagagtgtgccaggccccagagcgaaggaagggatcatccccagtgtctctttatttgcccgaaggatcctgggaccaacttcagagcagaagaacccagaccaatcaggacctgggaccaagtggcccatcctgaccaaagcctcgtcaagctcagagtcgggctcaagacatgaaagctacagatgccccaggtgccacgaaaatgccaaagcaagtggcagcccctttagggtcctcctgaaaccactttctcccaactttcccaacacgaataactttaacaataattcagttatttttaaataaccgccttccttattccaggccccatgcaggatacaaggaattcagcaacgagaggcagtccataccctgcagccactcacaggcctagtagggaatcagagacaacatgtgataaactcagctacagaagcatagtagagaggtaagcgctgtgaggggagtcagggagggcctcctggaggaggtgacatttgtgccggggtttgatttaggaggaaggaaaagtggagctgtgctcttagccttagggatcagcaagtacaaaggcacgacagtgtgacctgtagggtttgtggttgaaacaagagatatcaactatgactatcttttaaaaaatacgaagtttctggaatattgagaagctcataatgaacagaaagctgaaggatcaggcctgaaaaataagcagaaaaaaaagggagttctgggagatcaacaagcaagaagtccagcaactttgtagcacaaacaccatggccagacaccacccctactactgcacaccccaattctccagcctctggctgctggcccatccttcctagatgaaaagtcctgggcagcagggtccacctgctgcatccaggttacctattcagccacacccaggctgccaggaaatgatgagcagctggcatcttcacctctcagcgagctacacaatccactgagactcaacacaatgagagataccccaaatcaagaaacagggttggagactggactcccaaaacaataacacaaaggctgctctcgtgtgattacacagaaggggaaatgaaagagaaaagggcaggagggggcactgaggctcaagatacatgctggggtcgcatcatgagaaagttcaattattaataagagcaaatcatctaacaaacatttgccgctacctactaagccccagcattgcggttacaaatataaatacaatgttgttcctgcctacaagaaccgaagctagctctgtttatggcccgtgaacaagcttgcagttcatccaataaacatgagggagcccacacagctttttacagctagcatccacctggattgactagtgcttggaccattctattcgacaatatttccaacactattcttgctaaagcccagggagtacctaagctaagagctagaacaaggtgcaatcaggggaccatcgacagtgcctggcttgtgtttagtgcttcagaatttgcaaagcattttcccaaccatcaagtcatgggcaaatgtccaggactacatgtttgccatgtggatgatattccttctccagatgtcaaagataatacacaaccattctgttttgggtatataagggaatacagaaatatatacatatgaaaacaaattcgataacttctattggagatgagcacagagatgtatgtacaagaatactcaccgcaacatgattcaggagtaactggaaaggacttaaatatgcaacaatatggggtgatgaaataaatcgtggaacagtcattgcaatgggaaactatgaaacctttagaaaacatggttttatggaacatttaatgacatgggaaaatgctaaagaaaaaagtattaaatagcaaaatacatatttatgcaagtttgtgtgaacatatgactttcatttcattctttatagctatctctattgagcattttctcaacaatgaatacacattatttttgccatcataaatcatgactgcaagtagaaacaatttttaaagatgcttagttgacaacagtaccatgtctgcaatatatatttctctagcctggacatcaagcctgactcctcagccacataaaactcacatgaccttggaccagttgcttcacttctctgggactctgttttctcaaaaacaagtgacaatatctcgaactcatgggatggtgggacattagacaaaatgttgtacaggatgatgcctaacccacttcttagttagagtggacaagtagtaaatgccagctcccttagaagaaagcaacgctggccgggcgtggtggctgacacctgtaatcccagcactttgggaggccgaggtgggcggatcatgaggtcaggagattgagaccatcctggctaacatggtgaaaccccgtctctactaaaaatacagaaaaattagctgggcctggtggtggatgcctgtagtcccagctactcgagaggctgaggcaggagaatggcgtgaatctgggaggcggagcttgcagtgagccgagatcgtgctacagcactccagccctggcgaccgagcgagactccatctcaaaaaaacaaaacaaaacaaaaaaacagaagaaagcaaagcttccaatacttacagagctcgtgtggaaaaggtaacctgggtaggtgatggggtcagggtactgatgtgtaattgacctggttttagtttcctagaactgctattaaaaattaccatgagctgggtggcttaagacaacagaaacctattgtctcacagttctggaagctagaagtccaaaatcagggtattggcagggccacgttgtctccaaaagctctagagaagaacccgtcaacttgccttgcctgacttctggtttctgttgacaatcctcagcattccttgccttatggctgcattgccccaatctccactgccatctgcatgtggcctccttccctatgtgtgtatgtatctttgcctccacgagtcgtattgggttagaacccaatatgaccagcctgacctcatcctaatttgatcatttctataaatacttattttcaattaagtgtgacatttacagatatcaggggttaggacttcaacttatctttttaggagacaccattcaacccaaacagacctcaaccctccctttagacacatgagcagttagagcaaggcaggaacccacagggaaaggccccatggtgtgaaggaacaggccaggaccaccctggagacggtgctgcttccatgacatgctagttgggtgaaatgtgtgtgtgtgtgtgtgtgtgtgcgcgtgtgtgtgtgtgcatgtgcatgtgtgtcacctgtgtgtgtgttctcccaactcctcctccttccaatctggaaactcactaagctttttgtatttttctgctctagaaatgtgtgtaggaaaaatagaagaagctgcttgaaatcaaggcttccttccttcctcctttgttttttctaactctaaacttacttaagagagaatgctggggtctggaaggactgggccaagaagggtgtgcttttgaaggctaagatggtgaggagagaggttctcccattttacgaaggtgggaggtatggatctgctggtgccacactcctccgtggcagtacctgaggaggggcaggcccgggggggtttgtgggtggtgcacctgggctggctgggctgtgacaatggctcctagcctgagaaagcagcagcagaatcactagacctaaagggaatgcagcagtgggattcccagagaaaatcacaacagtctgctgaaaccccaggaaactcatagaaccctagggaagagggagctccaacagtgcctaaaatatagtctcagctccctggggactgagggtcagattcaggtttatgtaaagaagagaaataagtgagtatttcttatgtacctgattttgcaacctgatattcaaccctaatccataccttatgtttaaaagaatgtcctacaagtattcaaaggatatagaagcaagccacccaagccccactacctctggcttcagccctttccgaaggatacctccagcactcacatcttccttcagcccccaggatgccctcctgctgggccctgggctgtaattcagggctgtacctcagggatgacttgtggaaacccatgccaaagatggggaaggcagggctaggaactggtggtagctgtagttagttccataggcaggatagacagctagagagagggtttgtgagtgagtgtactaacccctgctcctctgtgacagcctcaataacgataaggtagtgaaaccaggtctgaagcctggaatgctagtgcaagagcttctcccatggacagagatgaggaaaagtctgtatttaggttgacacaaaagtagttgtggtttttgccattactttcaatggcaaataacagtaggtgtgtgtaacattcaattcacagaggtggggtggaggaaatgtctaagccctcgatgcagcaatgcatcctggacttgaaaagcctctctggcctgtcaggacccacagtagaacacctgctgagcagctcgcctttgtaaagcagcatcagtgagctagaagtgggggcaaggtctcaggtggacttggacttccagccccagagattgcaagaaccagaaaacatttagaaaaaccagcattgactaacccctactccaggcagacagttcacactcatgcagacatcctccatttaactctcacactggtccccaagataaagatgtggaaactgggagttgagaccctagggtcactcagctgttgtgtaagattggaatacactgacttgcaaacatgtctatgataacgattttgaaagcaaagaacaggatgttatgagtgagaataaggaggaagtccatctttagacagacggataagggaagattgccttgaggagtcctgtgagctgagacatgaagaaatcagcaaagcgccagatgcagtggctcatgcctgtaatcccagcactttgggaggccgaggcggaaggatcaactgaggtcaggaggtcgagaccagcctggtcaacgtggcaaaactccatctctactaaaaatacaaaagttagccaggcatggcgatgtgcgcctgtagtctcagctacttgggagtctgaggcatgagaatcacttgaacctgggaggtggaggctgcagtgagctgagataacgccacagcactccagcctgggcaacagagcgacactctgtctcaaaaaaaaaaaaaaaaaaaaaaaaagagagagagagacaaccaaagaacgaaagagaaatcaacaaagtgaagaattgagaaaacaaattctggtgagaaggaacaaggaacaatatgtgcaaaggacccgtgccaagaaagaatctgacacatctcaggaactaaaacacaccaggtatgagagaggagaagaaaaggggcccaaagaagacattggatcatgcaggatcttataggccatgacaaggatttcagatttcatcctatgtgccaggggaggccatcagcaggattaagtcccaaaatgacatggaatgagttacccagaccaagtatagcagggagctcgtcatacaaaggggatgggcaaaaagctgtggaacatctgaataaacagactcaaacttgacttccaagatgaggagaactgctggctttacagaaagaaaagcaagatttcagcctatgcccataagaagaacaaacagttttgcctaatccaaattcgctttcatgcctctctgcctaagaggcacacagagctgctgaaatccacaggcgcatcatgacagaataatttcagtgatcattatcaaatgcctctatttagaaaagcccagaagattgtattagcatgatccaatatttatgaaatgacaccctgccataatgaggggctgagaaaattaatattagaagcaaaagccatgtctttggggagagagagtagcatgagtaaaaagacacacttttactcagcttcttagaacttggttttctgatccgtaaaatgggaaggatagtagcaaagaggaaaatacatgatcagttagtaaagcacccaaaggcctttaatcttttttcattcattcctgtattaataaaaacacttaataaagactatttgcccatccacacatccatccaacaaattgctaatttagtacataggatgtctgatgtactgcattaggcactgaagataaagttatgaacaagattctcatggtccccattcacatagaacttctcatctgggagtaaaccatgcactggatgaataacacctgctgtgatgcgtgctactaaggacaagtgcaaggtgcaacgggaaccattacaaagaatgctgacccagactgagatatgaagaggacgcacaagacagtaggtaggggaaaggctccgtggaggatgccaatctcatgtgagttcccgaggcaggagagagtcagaacattctggcaattggcagaagccagtgtaaagtgagcagagtgggatgtggagcatgatgatgatttggaggtttagggaggatcagcactcagagctttggagaccacaacagggctttggtctttcctggagcaatgagaagcctcagaaagccttaagacagaagctgggtagagacaaggaagaaaagaagtaacatgaacatgcttatattctagaataatctcttcgacatctgtttggagaatggattaaagtccaaagagttaagtcaaggagtctgttagaaagttttccacttacccaggaaacagacaatggttgtgttcaccagggcagtggtggcagagatggagaggcttgggcagacccaaactatacttaggaagtaaaatggcagaacaaagtgattgattggaaaagtgggtaagagagagaaaaaagagaaacatggccccccggtttctgaatcagtaccagtagggtgaagtgagctttctggagacgaggaacagtggaaagtgagtagacagggaaggggaaatgggtaaatcaagagttcagttttggagatgttgagcttggagagcctacaacatgctacagggctttaagtggactaaagatgagcagaaagagcatatgtgaatacacacacacccatacacatgcatatgcacacaccgccatatacacacacccatacaaacacacggacacacacacacacctcccatacacccccatacacacacacccatacacccccatacactctcacacatacccatacacatgcacacacaccctccataaacgcacacccatacacacacaacccttacacccccatatgcacacacacacacccccatacacatagacacacacccccatagacatgcatacacacatacaccaatacacccccatacacacacacacacacacataccagtacacaggcatgcacacacaccacacccatacacccccatacacacacacacacgcatacacacacgtatacacactataagatccagatttattgggccactatcaaggagggccatgaagagtagagcagatgtgctatgtttaagcagaggtgtcttggattcttggggtccctaatgggatgggtgattctatcatgtaaaccaggcagtactttttaaagtcagcatgattgggcaacagacagaggttgttccacactgccttgctaataggcatgcacacctgttgatgactttgctcattcaaagtaaggtcccaccagatctgaaatgctcaattttgtaccacagcctaactttattacacctaaggcttgtatcaacacttttgagaaatttatacaattaatgcccttaataggagctatccataaccatccagtgcctcctgttttggagccagactcaaagtgaatgaggccacaccctcacctgggcatctctgagcatcttctttgctcccactttagtagcatcctggaaaaccccgttctccagaggtagccaagatgacatggcagctgggcagtgggttgtgtaggtgtaaaattcctgagacatctaggctggaggcataaatgtcagaatcaccagcacagaggcagtatctgaggccatgggagtggttgaggccaaccacagaaagaacacccagtaagcctgaagaactcttaatactccatggccagagtgcactgacaggggagactgagaaagagcacctgggggattggtgaaaaccaagacaggtgtgggttaaagtgagggagcctttggtcaagcagaaactgtagaaaatggcctcccttctccaacaagcagttgtctttacaactgcagcagggacatgtgattattcagaaaagtgagcttcactttctcagagtcacaactcttcctggcttctatcaccaggtaagcctcttcaagatgcaccttacgcaggtataccccacatttagagtctaagtgttctctctgagaagacctcctttgggtacttcccctgaaacatatcaggtgtacctcacaggcctgccccatgcaggtatccatcaagaattcacactaggccttcagcgctgctggttaaggacaaaaggttggtatttagaatgtcaggatgtttaccttataatacaatatataataataatataataatatataataataatatattatataataatatgaccttataaaaatctgtggaagtatccctaaatatatatataaattatataatatatatactatgtaacatatataatgtataatataatatataaccttataataatctgactgtagaagtctccctaagtatataaaatatatgtaaataatataacacacaataatagataataatatgataatatataacaataatataataatataattaatataaccttataatagtctgtactgttgaagtttccctaaatatatacaacctatgtccatgtggcctggaagaaaagcagcgaccgtaaattcttcagaagctctttccctgacacgccactgtcatcaggctcccaagcaaaacccagtgatacctacttgtagctaaagcttagaatctcgacgctaaaagaaatgctgaatccaggtgacatgtgactagtatcaaatcctgaagaattcattcagccttggtttgaccacctctgagtgtggggaactcactacctacagagctatcgattgccatctcagagagctcaatgtgtaagtaagttcttccccccatgattcacggtaaaaactagccatccccattacagccccaaacatgatggatcacatacctgtgggcactgcctggtccagcattggtttctcccatgtgttaatctgctcccaggtgaacccattggtccctagagccacactataaccacagttgctgtagtgctcatcaaaggaacagccacctgtagacaaaagagatatgggtaaatacattcccgtgtctgaggcttggttcgttacctctgtctcgtcggctcttcatttacagctttgaattttaaactctggagaagattttccatatatatatatatatatataaaagatgagcaaattggatttttatatttgctttggtgctctcaggaaaggcactggcatctgcaggcctccgtatttaaaaaagttaataaggctagttacattgatttcaatcttccttcctgagaaagtaaacagcagcgtctcattctaagtaggaaaaatgaatgcaggggcatgcctctgtaattgctttgtgcagcacggagagatgctgtgaggcagcggaaggagcactcacttcccagtctggcaaaactagacagccatcaccttcacaaggctgtgtgagctcaggccagatgcttcatacctgagcatctccgtttcctcacctatgatacggagggaaatgtccaacctcacagaaataccatgaggaataaatggaataacatgtgaaaagtaactgccacagaatactttctcagtgcccacctgtttctctgtaaaaagcagtctgaaaaatcatttttcatggagtgagaatcgaattggtaagaaattagacaatcatgcacctggaagataataaagtcaatgttgatcatgtttaaagcttctccctttaactttaaaggtcaagccatccaccatttgacaataagttatattcatttgctgttgacaaggattcactgagcatacgctctgagctgtaagtcccatcaaggtgacattgagagagatgtggggtgtacaatggaggctccaactaggaaacactggtctgtccagagaaatgagcccattatattctggaggagaaagcagaagtggaggagaagtgaacagggctttgaaggatgggagcatctccatgggcggagggcaggaggaatggcattctgagttgagcctgcagggtgcacaaatgcagggaggcagaactgggactgagttctacagcagcctcctggctggtctcccagacctgtttcacactccagtccatcttttccaatgtccctttcttgtctctttaatgttcacagggtgcatcacatcaccatcctcctcctttaaacgctcacaggtttcccaccccacagagaaccaatgtctgctatagattaaatgtgtgaatgcctgcaaaattcatgctgaagtttcaaaccccaaagtgatagtattaggacacatggcctttgggaggtgattaggacatgaaggcagactccacatgattgggactgggattgggaccagtgcccttataaagagaccccagagagctatctcgccccttccaccatgtgaggacacaaggagaaggtgccatcaaagaagcaggagctgggccctcaccagatgctgaatctgccaatgtctcgatcttatacttcctagtccccaggactgtgagaaatcaatttctgttgtttataagccactcagtcatggtattttgttatggcagcctaaattgactaagaaaataaacaaacatggctttattcagttcatcccacactagcccggccatgtgctcattaacatcacactattgtctccatcagctgcaaagaaccaaattctttctctgcaccccagacctgagatttcctctggatagtggtggtggacatcctgttgacagatctgacatagaatacagtccaaacaccatggaagaaaacctgtgatagaaaagctttctccactttcctttcttgttggatatggacacccagaagagctggccttcagcaactactatggtccaaatgtgcgtgttccccttaaattcatatgttgaagcctaatccccaatgtaatagtattaggtggagcctttgggagatgcttccaaaggactgtgagggctctgttctcagaaatgagatcgcacccttataaaagatgccctaggcaaatcgttcaccccttctgccatgtgcggactcatagaaggtgccatctataaggaagggacctttaccaagtaccaaatctgctatcaccttgatcttgaacttgccaacccccagaactatgagcaataactttctattttttaaataacccagtttaaggcattttgttataacagccgaaatggattaagacagcaccccactgagtatctctactctgtagaggaaagccacccagagactcgcctgaccaggaatatcagcattcaacttttcaggagcaaaatataaacttttcttgtcatatgccactgagatcttagggtttaactgttagcaccgtagagctttgtacaacctgactaatatataaagtgtgtcatacctcaacacagtgatccaaagaaagaaagaagaagcatattctcccaagcatttgctctgtgttgggcaacatattcgacaccgattacatatactatctcattagctgtcatgtaatcctcacaaaccacatgaggtacattttatctcaactttaaatctaagagaattgatgcactgaggggataaatgacctgctcaggcaacatggaaggaaagtgttggagccaatattaaatccatggcagcatagctgtagagcccatgcccatcctaatagaccagagagagaattattcccccaaaccaaggataaggtctttcacttataaggtaataagaggggccaggcagataaagaacttccaaggtggttgggcctctccattcaaatccattccttcacttattctagaaacattcaacaagtttttttaatgggctctggacatggcacagaattgacagatatgatccttaccctcacaaagtttgcagaatagagtgaaaggtaagcatgcaaatatacactgaagatgcaatggaaaatatgctttcttatgtatgtgttgatgctaaaaaaaacaagttattattttagttgatggtttaattaaccaaattctcttccttcttctagataagatttaagaaggctcacagctatacctctaggcatcccaggttacagatcccaggcaaggtcacattaacacttgcccctagtccgttggatccattgcccacccctcacctccctgcctctgcttaactgtaggtagacactcagctgatactgagctgactgctgacaggtcctggccctctgaggactagggatgtacctcctcttcacaggcactcactgaaccaccttgcttctcccctctgctgagctctgttggtcacttcaatctgcagcaggtaagcaaatgcttttcccttcttacagtctgctctttgaaactagggttccacagcagcaggccttggacctcagtgacccaatttttattttcaaaccacagtcctctctttgcctctgcagaagaactcacttagagtgaatttaaaagcagctttccactctatcttgagccactatttcttcagaatattcaggccccactgtcaattctattccactctgccaggatttgtcatcacttatgggatgacttatgcattcaggacagaaaatggggaccgtaaggtcactctggggaccttaatgtccctcctacagaagagtttctagaaatgggctcctgttctgcacttttatcactcatacatgtctgaatcccagcaatacacacagttcatgattcttccatggagcccttgggctcccagcaaagcagggaatttcaaggaatgctgcctaactggtcactggtccaaccaaagcagcaggttaaacatagaaggaggaaatactgcatgatgacaaaaatcaaattgaggacaggaaaagaaagaaaagcaggacagaaggagggagccacaaatctatgctgcgattttccacgtgttcctttactaaaagggggttacatatatagctctgagcttctgacacccaatagaaaaaaagcaaaacctggtaaggtactggacactctgtgtttttataataaaagccaaattgctcagggaaatgacaaccatttcaggtgctttgatcagacaagaatttctctgcaggaatactcataacagaaaccccatatcccataatgaaacaacatctgcacaaggggctgaatggccaatttcatgagactgtttctcatcatcattctcaatataaattgatagcatcacctaaacacacaattcagtaaaagctcattggggcccaacgcaatgcagtctggatacccactccctattggtctgacttgactcaaaggtaagttttaagaactattcaggggagatttttaggcaacttttatgagttttctgtctcccacattgagaaacagagtggctatgaactcaagactacataacccaatagcaactgacactgacatctgggtacaacctgttgggctcatatcccttccctgtttctgagccttcattttctgctgtgcaaggcaaagggctgaacaagatgattgcaatgaaccttccacttgtaacatttaagaaatccagagattcagaaagaactggaactctcagaaaccacagagatacagacccatgcagtcagcacaagtacaggctagggtgtcctgccactgagagccaccaagaggaggaggagaaattaaagccaagcttcccctggaccgagaacagaaaacatttaaacccagtaacatctatctgtcttggagcaattcctagtggccataaccaaaacaggccccagacgttgctgcaggtgtttatggcagcttaggggagatttatggttccagagagtccctgatacagtttggctgtgtccccactcaaatctcatcctgaattgtagctcccataattcccatgtgttgtgggagggacctggtgggagataattgaatcataggggtggtttcccccatactgttctcctggtagtaagtctcgcaagatctgatgatttttaaggggtttcccctttcgcttggctctcattctttcttgtctgccaccatgtaagatgtgcctttcaccttccaccatgattgtgccgcctccccagccacatggaactgtgaatccactaaacctgtttctttataaattacccagtcttggctatgtctttatcagcagtgtgaaaacggactaatacagtccccaaagacactcatctggatgctaacctcattcaggtttgaagagcagatgacatcatttaagtgatctcgacctcaccacaatcatttttgggaggaaggaaacccaaaaaatctacccccatcccaggagctgggctcagctgaggtttggtgaagatccacataattgggggaggacagggaagtgcagccactggccaaggacccagcacctccccagaggagctatttccctgggcaggctgaggtcaaaatgtggcaatggccccagatgctctgatgtgaatcagacataaaaagtcaacagagaaatggaaaactgtagcaaggaaattggattttgaaaatccatttgggtttggtagtgtatagcatatcagcatctgtaagggaagtaaaaatagtgcaggatacatactttaggatacattaaagcataaataaagtttatagtgtcaatcagaatttttttaaaaaacatgagctcttcttttgaaaatgagagaggaatagaattcaataaaaatataaatgtgtcttcctctgcatttcttagatatgatcctgtgtattcttgagctgaattaagttttgtagaggaactaaaagattcgttgggctcccactgtgtgccaggcactgtatttgaactatgtaggtgtatgtgtatatctgtatatatattaacgtagatgtaggtgactcaaacaccaccactctctaagacaggagtcatcaaacattttccataaaagactagacagtaaatattttcagctctgtagtcacacagcctctgtcacaactactcagttctaccactgcagtgcaaaaatatgtaaataaatgagtgtggctgtgttccaataaaactttatttgcaagaggtgacagcctagatttgcccaggggctatagtttgccaacccttgctctaagaaagaagtattgctttcttctttgtataaatgaaaacttgtcatcagagctcctaaggaacttacccagcgagggaaaaacaatgacatcatgtacagcagtactaatagcaacacctccttttattcacagttgaatgtaatggaggctttacctacagtatctaaccctcaccacaagccctgccattttgattgtaccattttatagatgatgtatcaaactcacccacatgaaggaatggagccaagatgtgagccctagactggatggtaccaaagcctgggtactttccattgctccaacccagcattcttttgaacactctgtgtgttcacagaatctggtctcaccatgatgcttccagaatagaaagatgttcttttaatatccagcagtggagctaagtaaaaaaaaaaaaaagaaaactgggctaaacctaaaaaaggtggaaaattgcctttacttgccctccgtggtaggcactacttttggtagagctcatcattttgatgaacgtggctggagattaaggtgatctgccatggatgaggatacgcagaaacacctgctccctgatccatagctggtgctgaaagtcctagtagctcactccacatacattctcatgattcttgggggagacgtcagcactggggaccctggggtgggggaagggactgagaccacaggactgcgtccctccaactaaagctccatagcaacagggacatgccacaagggtctctttcctcagagtctgtcccatagtatatgcttgcactttattgttcagtgaatgcctgaatatattaaaaaggacctccattcacgtagaggagccaggctggggcccacagagaaagctctcatccactgtcattgggcttctcctgggggccacggtgaacccaggggaggccttgcaggggagtaagagcgaagaactcagaaatcaggctgggacctttaagaaactaccatcagagtgaacaggcaacctacaaaatgggagaaaattttcgcaacctactcatctgacaaagggctaatatccagaatctacaatgaactcaaacaaatttacaagaaaaaaacaaccccatcacaaagtggccaaaggatatgaacagacacttctcaaaagaagacgtttatgcagccaaaagacacatgaaaaaatgctcatcatcactggccatcagagaaatgcaaatcaaaaccacaatgagataccatctcataccagttagaatggctatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaaggaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtggggggagtggggagggatagcattaggagatatacctaatgctaaatgacgagttaatgggtgccacacacctgcatggcatatgtatacatatgtaacaaacctgcacattgtgcacatgtaccctaaaacttaaggtataataataataaaaaattaaaaattaaaaaattaaaaaaaaaagaacatttgctctgatcacatgaagggccaaaacagatggagattctgaatccgagaaagaagggaagtccaaggttgatctaaggaagcgccataaggccaccaggaaatggagaagagtaagttgagaccacggacaggtggagaagtcattcaaggagaaatgagagtatttgcgagaggaccagaatgacagctgagactgctaaggagtaaactgtgagctgagcttgataacggtttgcaaggaccaagtaatcacaatgcaaggtcaaagagacggggacagaaagctgctgagcagacacagatcccaactagatctgagagatagtcaagataaccatgtccagtgcccagcactgttctcagtgttcaccagtagtaactcatttaattatcccaatcaccccacgagatggatatgatcattaaccccaattttatagacaaagaaatgaaggcatagaaaggttaaaaaaaaaaactatcccaagatcacacaaataacaggtggcaaagcgtggctttgaacccagactagctcagtctatgtacctactcattatactaggttgccatggtgatgaactgaaaagataaccttgacctcgaaaggaacctgttgagggaaataagtggctgcacagttcttccccaatccctgtaaaatggcattcagccagtctgcatgccttctgcccccattcactgcccaggcccaggatgccaatctgcacttctggaggaccaggcatagggggtaggctctgccccttcacctcataacggaggccatagtgttatagggaggagaagaaatggagtagggggcttaaagtcaggaaggcaggcacatgcagagaacagggggtggtgtgggcctcacatagtaatcgctggtatgtgaagagctcacacatgtgagctgttcagacagattcaagatgtagcaagaataaatggttacagggcacagaaaaataatgtggtcaaagcagttattttttaactggggggttgttaaactttttctataaaaggctagatagtaaatattttcagctttgcaggttgtattagcctgctagggctgctgtaaaaaaatgccacaaactgtgtgacttaaacaatagacatttatttttacacagttctggaggccaggaatctcagaccaaagttgggcagggtcaggtgagggcttgcttcctggctggcagatggccgccttctcactgtgtcctcacacagcctttccttggtgcctgtgtactctgatgcatcttcccagcccaatggaactaaggtctcatgcatataacctcatttaaccttcttataggccttgtctccaaacacagtcacatggggagacatcgcaaaattccttcacctttgtcattcactaagataagctaatcaagacagtgaaatccatcacatgcacagtccacgcaaggagtgggaagtactcaggatgtgtaccccagaggccaggaatcttgggggctgtcttagaatcccacccatcacagggggccacatgttccctgtcactagtactcaacaatgttattgttgtacagaaacaatacaaaaagaatgggcatgactgtgttctaataagactttatttattagcactgcatgttgcatttcatatgattttcacatgtcccaaaatagtattcttcttttgattcctaaccatttaaaaatgtaaaaaccattccttatttgtgggctatataaaaaccagtgaacactcagatttggctggtaggctatagctggctgacttctctttaacgacataaaaattcccagttttagcagtcactgaattttaatacagtcccgtgtattgccatttgaatgtatgccatgtgctactgaccctctcctccaaagactcgattgcagaatgtttcttcccgtctctgggaactggagggaggaacacgtctcccattgtctgctagccctacggataagggattgagtaaagaacactagctctttagatttaattaaacacttcatctacactacaagcttgtgttcttcattggtaaggagtagtacttccactttatagataaggaaactgaggcaggagtggatgatgcactcagcgtcagatcagggactgagccaagactccaatcatgggtttgtttcttggccagaaggtctgacaaccaaggcgacctccaagataggtccacctacaaaatttggagcgccccttgcaagactaaaatgcagagtctcttcttcaaaattaagaaatcaagatggtgccaggcgcgatggctcatgcctgtaatcccagcactttgggaggcctaggcgggtggatctcctgaggctggagtttgagaccagcctggccaacatggtgaaatcccgtcttcactaaaaatacaaaattagccaggcgtggtggcgcatgcctgtaattccagctactcgggaggctgacacaggagaatcgcttgaacctgggaggcggaggttgtggtgagccgagatcatgccattgcactccaatctaagcaacatgagcacaactccgtctcaaaaaaaaaaaaaaaaaaaatagaaatcaagatggtgatagcagagcattaaaccaagcacgggctcttctcttctgagttccagggcctgtatgactcagtgcccttgaagccaatcctgctctgtggacacatattccaaagataaaatacctcaacccccaaatcatggagattccaccctcgtgccaacaaatgctttgaaggcagggtaatatctaagtggggcttattaattgtgaacaccctatcgtgggtagctgattcttgcccccggaatgaatgtaaaccagccttccataaattgaattccttttctgaatatataattgaatttggagaagtgtgtgccgggggggtgtttaaataagtgcacaaatatggtaagaaggccttcacaccattacatctaattcagtaagcaaaaataatggcagggcacgttccaattagtgtttgatttatttgctttaacaaatccaattagtagaatgttttataaagtcatccaatgtcatacattcatggactcaacagatacaaacaatactcctaatataaaaaaaagttttaaagctctttgagcagtgaatttattataaataagatgatgtctctctgatggctcgagcattccccaaggaccaagaaaacagtgtctgatctgttcatttggttctttttctgtgagactttgtgcagcaactcaggttaatgtggcccattatattaaatccaggaatgaaaacaacaaaggtggaagttagccaaggaacttcaagggagaataatgaacttgctgctgggtgtcttctagatcagagacgtgtttcgacttccaaggcagcacagtacagtgggaaaagcccaggggtaacagaaacggcggtgccctagaaccaaatctgatgccttcatgcccttttgggtctccagttttctcacatattaaataaagagttcaatgaggttaagcagcccccagaaatgcccaccttgggtggtggatgatgttctttgcccagggagacacagaacaaggtagcagttaaagctatgaactccagagccagcatctaagctctgctatttttttttacttagttatatgaccttggccaacttatgtaacttctatgtgcttcatttctccatctgtaaaactaggataatagtgcctaactcttaaggctgttatgaggattgggtaatttaatatttgtaaacacttggaatagtacctggcacgtagtcagtgccaagttgtgtgttaaattaatatttaatcccaatctataaattagaaatggaaaaggcagatgtattacatgtggtcagctggcataatctcaccaaacaaacaaaatgttttaaagaaactgtatctgagtctgcccatcatatcccttatagatcatcagggctaattgtggtatgctattggtctgcatgggaaatcccagcttctgtcaccccttactactgtgtgactttgaataagtcatgtagactctagggccagcatttctccatgtgtgacagaagcagcaagttgaaccctctccgagaacctttttgttgctgttgttaagagacggggtcttgctctgtcacccaggctggagtgcagtgtcatatcatagctcacttgaagcctggaactcctgggctcaagcaatcctcctgtgccagcctcccaagtagctaggactacaggcatgtaccaccaaacttggctaatttttaaattttttgtagagatgggttcttcctatgtgctcaggctggtctcaaactgctggccctaagtgatcctccctcctgggccttccaaagcactgggattataggcactgtcccccaccttctaagaatcctttgacttctgacatcctatgggactacaattatgtcctcccttcatggtacctagctacatttgctgggacacaaaaagtaccaagagttccctgaaaataagagcctctgttcagaccatcttctctacatggtctgctatgggcctctgcctggtgcatttgtacattatgaaaaaagaacatcatggggtatggcaagcagattctgtcttctcacgggccccagccttcccaggcaccagtttgtgagcagacactgtgagatgcactgtgaccaaggagaaagtgcgatgaaagaaggaggccctctgttgggtcagcgccagcctcaacctgccgaggagaggctgagagaacagggggagagaacagtcaccttcagttgaaacgagtgaagatgcttcaagttggaggccagctggagagtccaaccagcctgaaaagtggtcccgcccaacccagtgagtcttctttcccaaaaacagcatgggagcagatgcagggattccaatgctctatcaaatttaaagagagaagggacggtctggcccagctgctaattttacaggtggacaaacaggcataaaaagggcaaggctacaaagaaagggggccccagcccagagctctgcccactcagatgccagaatagcatctttcatcttttctcacgcaacagtgctatcttttccatttttattttgagggagcagcgaaagaaacagatggccatgggtcatcccccgtctcagagaaacttcagatcagtcgggaaaaggtgaggaaaggttttctcgacacagaaggacaggcttaaactggttcctggcagctgtgtcagcgtctgaagcctgcagaagcccaagccaagctcttcacggtctcagggtcttggcacttgctgttcccccatggaacactcttgccctagcacgtgatgtggctgtctctgggcatcttccacatcaaaaatcaaatgcaaaacagcctcctcccttcttcagtcattctctatcataccaccttgtttatgcttgacgaggctgtttctcaaacgctttagttacattctaaaattgtttatttactcatttacttattttctgtcttcccactaccagcctaagtctaccagggcaggaagtgtgcatcccttttattcactagactcatcaaagagcctagtactttaactcttgagagcttgagggaaactctttaaatgctcatgaatgaatgaatgaaatagaatatgatgaagtgtcagaagcacaagatttggtatcagaggatgatgcatggcttggttatggcactttctttgtgactttggatgagtcagaagaaaatttctgagcctccacttcctcatctttaaaatgggaacaataatgatagcagcttgcatgtactgggaactatgtgctatgcaccgtgctagtccatttccatggattacctcattcaatcctcaaaagagccccatgagttaggtactgtcactatccacactttatgcaagatgaaaccaagagttaaataacatcacccaaatatcacagctgggaaatggccagagatattccgcaaagcattgcaacaggcaaattgccctgtaaatccatcaaagtgggggtgaggtcacattctgagagtcacagactagcaggtggtagaagaaaattctgagattggttcatctcaaagcccagcttggctcaagctaagttatattcacagagccagggggctaaacccaggtccttcccattcagtcaggtgtgtgtgaggccccttcctcagtaataagttataatcagctgtcttcaggtgctatctcttgagtggtccctgatggtgagcaggcagagactcctagcaaacatggatgcctggcttgtccccggtatgaatgcccaagtcctgtcatctctctacccctttccagcacttcctttcatcacagccacatccttgagttctgactggctaaaatcttgcttcagttcaccatgtcccccatcacacttcattcccgtagcatcaaaagtggtaatgccacccagagcccatatcacatagaagacaggagatgaaatctgcatggtgggccctcctcagtttcttcatccatgaaatgtggataataatagtacattgttgggagaaaagctgagtgttgggagaagctgaggcagggcttgcatgtctgacatactgtaaaagagtcttggaacatgtccggggtccagggtctaaaacccctcgtggcctttggaacaccaagctctgtgctaaagggtagaagcctaccctgaagcaccataacctaagcccagggcataaaacccctcgtggcttggaaagaatccagggctcaaggcataaaacccctcgtggcctctggaatgtgtctagacttgctggctccttgctctcccaggactgattgtatcttgagttaaaagaacctgctctccactatctcaagcagcagaacatgttccatatgctgcaaaggaaatgctaagccgtcacagctgtagatcatgcacttgccctttcgacccccacattctcaacacctgtttctctgtttgatcaccaataaatagtctgggcttccagagcttggggtctttgcagcctccatacttgcgttggccccctggacacactttctctctcaaactgtcttttctcattcctctgactccaccggacttcatcaccctcacgacctggtgttgggtctgtccaccccaaaagtacattcctgataagctgtcatgaggattaaataacatgtaagacagcacagtgcctggcacatagcaagctctcaacaaacattagtaattattactcccatcacagaatgtcatacacacacacacacccttctttataaacataaatttaaaagaagaaatgaaacacttgtgtatgtccacactgataaatttctacacttagatactcaatgacatatacttaacacccgcaatcccatacctgtctctgtggaagctcctggcacgtcccccacggtctctgtcttgtttagggaaccagtttgtgtcttctgttctggcttgccacgattgctagaatacatcgacttgaccacagtggtagcacagttctgtgtaagaaacaccaaccccacaagacccccatgggctgcttcatgccccctcctctctgggtgtcactcctcctgccccattaaggaaaggaagcagaaaaataaatagagaaaccaatgtctttctccaaatcaggaagttttaacacagagtacagcaaagtatgacctatgaactagaaacctagcctgcctcctgtttgtgtaaataaagttttattgaaacacagccatgtttatttgcctacatatcatctacggctgcttcccagctacagcagcagagttgagtagctgtgatggagaccacatggtctgtaaagactgaaatatttactatctagcctttgatggaaaaagtttactcattcttccttccaaaggcctgaaggcaatctaatagctgtcacccagggcatgcaggaaaccaggagatggatgacggcagcttatttttgctagtcccaaaagttgctaccactacaggaacatctggctttctaaaaacctcttcttctgaaagtgacttatttttaacatacaatttttttcagaggaaacaaaaaaaggaaaagaactaaggtccagagcctctgttggcaggcctcccccagcaagttccacttcctggaacagtgagtacactgtcctgatggctcaaggtcagtagagtcacatggtccacacatggctctctgtggaactctggagtgccctttgaccccactccacatctcagctccattagtgacctggcttaaagcagctcaggagagacagaagccaggtgctcccaccttggcccagtgaggatcagagggaggagaagacaccggtaatccccagaagagaacatcctgatgtcatgcaaagctttctcaagttctaccctgggaaaatcagcctttggtgcccactcaataatccggaaccattagatgccaggtactttccaaccactgccttattttgtccttagagaagccctgtgagttgttctttaggattcaagacaagattttgcaaaattggaacctgaggctcagagaggttaagtcacttctgcaaggctgcacagcttataaaggacagagtcgggattagaattactttcaacttgatcccaaagcacaaacctgctcaactttatgataatgtctcttgcatgaaattcccactcctccttattaccctcgctgaatttattcaacccatatctggatttcattcattaatgctagatcaagtgtctggtgtatgctagacattattctagctatcagggataaagcagtgattgaaagctatgacctctttctccatggagctcacatactagtaggggagatcaacaatgaaaacagggagagaagtaaagcaggtaaggggcccatctcggctcttgacatgacataatgccttgaagatgttaggcatgcaataaacatgtgcctaaggtgggtatggaaatggatccttattgagcagctaatctttgctaggcatcaggccagacattccatgtaatcttacttaatcttaacaaccatcttgtaatccaagaattaatcatcaccattttaaagataaataaactgaaaatccagcaagttaagaatccaatccatattccctacagttgtggattctgactgttttccttctccaaaagccatcatctttctgctgcaaaatgctatgcatgcagaagcccaaggaacatttaggactggctgacagatattggtttatgtacccagtttttataagtatattaacatttaattacatcaagtaaagactagggttccatacagtcaattaaactcgataatagcatccggcgttctataaatcaccaaactggtaattgtgtagataaaatattattgcggtctgagtattatcataagtacagttggttgtcagaagtcctctcaaaacagtgaagctttggcaatttagtctgtagttgccagttggactccgtgtaccttggccgttaagtgtgcattaattgtaggatggaaggtttttaaggacagaatacaaagaagcctcaactaagctaaagctgaaattatttggataccaagattgggtcaagccaaagggaatggtggattcagcatgttttgagatcacaaggatggtgatggtgtcttgggtagatgtaattacagctgaactagcacgtcacccagttaaatcagcaagccttctgctcttcctctctaatgttgacactttgtttccctggataggtgaatctcaccaagaaggaagtgtacacaaaggagaagcaggcactctcctagcaattacaggaagtggtctttgatgaatttcaaagagagatggtagggcagtcactaaggttcctaagcaaaaaaacagaccatctacctcaaagctgtctcatctctacctctctgatgcccgggagttcatgtgcatccaggatacataaacatgtttctcctctttggaacaagcactcagcaacttccagctctacgcacatttttttttaatctgcaaaggaccaatgcagatgatcctatgagagcagcctctgccaacctcactccacctcaggctaaaactctttgaaacagaagtgaacttctaacgaagctgcaacttgctaaatcacatagtaactcggggcctgacaggacaccacaggcaggtggtcttgaagattgaggatttgcctgagagaaaggagtcctgcatcaaagacttggctcttcctccagctggttgcatgaccttggctgagtcactttctgtttaaaatggatctggctggaagctcttgacagtctaccacagtaccaaggcaatgcccataacaacagtggaagaggtgaaaaccttccacagaattgaaaacaaggtcttgatacgggaagggggcagggaagtgctgggaagagaagggtgggtccctggctagggctccaccccatggacctaggtgaggacaggcatttctgttttcatgcccaaatgttgcacttcccaagaccaccctggcccaccacacccccatcctgtgcctataaaaaccccgagactccagaaataacaccacacatctacaaccatctgatctttgacaaacctgacagaaacaagaaatggggaaaggatcccctatttaataaatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgactgaaacaccaaaagcaatggcaacaaaagccaaaatagacaaatgggatctaattaaactaaagagcttctggacagcaaaagaaactaccatcagagtgaacaggcacctacagaatgggagaaaattttcacaatctacccatctgacaaagggctaatatccagaatctaaaaagaactcaaacaaatttacaagaaaataacaaacaaccccatcaaaaagtggccaaaggatatggccagacacttatcaaaagaagacatctatgcagccaacagacacatgaaaaaatgctcatcatcactggtcatcagagaaatgcaaatcaaaaccacaatgacataccatctcacaccagttagaatggccatcattaaaaagtcgggaaacaacagatgccggagaggatgtggagaaataggaacacttttacactgttggtgggagtgtaaattagttcaaccattgtggaagacagtgtggcgattcctcaaggatctagaactagaaataccatttgacccagccatcccattactgggtacatacccagaggattataaatcatgctactataaagacacatgcacacatatgtttattgtggcactattcgcaatagcaaagacttgaaaccaacccaaatgtccatcaatgatagactggattaagaaactgtggcacatatacaccatggaatactatgcagccataaaaaaggatgagttcatgtcctttgtagggtcatggatgaagctagaaaccatcattctcagcaaattaacacaggaacagaaaaccaaacaccgcatactctcactcataggtgggaattgaacaatgagatcatttggacacagagcagggaacatcacacactggggcctgtcggggggtagggggctgggggagggacagcattaggagaaatacctaatgtaaatgatgagttgatgggtgcagcaaaccaacaaggcacatgtatacctatgtatcgaacctgcacgttgtgcacatacttaaagtatatatatataaaaaaaagaaccaaaacaaaaacaaaaacccgagaccacagcaggcagaaacacacaagctgctggacgtccagaggaacacatcagcagaagaacccacaagcgtctggacatcaagaggaacacatcagaggaagaagacacaagtagctggacgtcaaaaggagcatgctggcagaagaccacactggcagacaccagcagatgctggaggctgaccgtcaaaatgacacagaatttggccggggcggtcagaggggagcacagccgctgagtggcccggctccagggggaaagccacgttcccactccatctccctcatggctccctcatctgctgaaagctacttccactcaataaaaccttgcactttttctccaagcccacatgtgatccgattcttccagtatatcaaggcaagaaactctcaggatacagaaagccctctgtccttgcaataaggcagggggtctagttgagctgactaacacaagccacctacagatggctaaactaaaagagcacatgcccactgaggcttcagttgtaaacattcatccctagatgctgctgtgagaccagagccctacagcctacccatctgcatgcttccctagaggtttgagcagcagggcactgaagaagtgagccacacccccatcacacaccctgtgagggggacaggggaacttttcccgtttcagtctcacaataaaactattcacctgcatctggaggaaactaaaatggattttaaaatgcaaatgacagactacctctgttacactcttgttctaatctggaaaaaaaaaaatgtgaaacctcatctgcctggaattaactagataaaccatgtgtttcctccatactgtcaacccccaagttcaaaattaccgcatctaacaaagagcacaccatgtcacaggccccctaatataacacctggtttaggcaccgggagtctctctcttccttacaacctactacctacagtcagaaaatgtaacagtgaggggaaaaaataagaattattatgagtaaatgaaaaaaatgaatacagtaggaaagaaaaagaaatcatcataaacatttaaaaagaagacctctgaaaatgatccactgaaagaacccgaagaacgctttaaatagtgtgaagtgtcctaaataggagacaaagagatgcagccctttgtgaaacaagaagagaaagccacacagagaccccaataacctgaaaaaacaatcggattaggagacagatccgtgtgttcataaaggatctcagggaaagtaaaaatgcaaaaagcagaatccatatcagtgtatcaaaccctccaacctcaacgttgactggaatgaagaaaaggaagcaaaagtaacaaagaaaccacaaacattgaagtttttttttaatgtttttctcattgacttggaggacgcgacacaatttgggcccacccaaaatgccacgaatttatacactacacaactcgttcttaacagagttgtacagtatgagatgaagtggaggaatttcggaaaacccagcagtatccgccagctggcatgtcaggggccgtggcgtgagagagctacaaaaaagatgaaggatgctcaacctgggtgtccttcagcctcttgcatcaacagtacttgaagtcattagtttgttattgtccttgtttcccatctaattcagatctctcagaggccctgggaacttctctcatccaggagagccccataactggaagggtacaagtgggggcagagtgaaaatagtaagaaatggcaaaatgattttccaggtgccccaaaacagcccaccaaacagaaataaaccatcatgattgtgcaactttcctccaggggctgacacaccctgaagccaatgaaagagaagttcctgggtaccccaccaagcataagaacccttcgggaagaggtaacagtctgaaagtcggtgaagtactggtggcagagtagccccccatgtcttctagggctccagccattaggagctgcaactgcgctaaggcagaaagaagcaaagctcacatcccaaacacgacccaccgggaaggcagcaagagaacgggggataagcatcttgaagacactgatgtccagcccacgaccatgtgaccttggacaagtcacttaacctctcccagtttcaatttcctcatctaagaagataataataatagccacccagaagcacgtctgaatttttatagcccgaatcttaaacaccttagggagggagcattctttaaggaaaatagtacaaacttagaaaagagactatctgacatgagaaaataattcacaacaaataataaattcctaacaaccagcaaataccacaaacactgtacaatccagaaaaataatatttttataaattatctttctaacaatattctcccctacatttctggacatattttctgggatgatctctttatgacaataattttgcaatatcattttttatagagagactagaaacttcagtgtcccctctagcaggttaatatttattattattaatatttttaaagtctccttcaagttcacaagtcattgtttatatagagtcatgtaaactttaaggctgtggtcaagtttggagaaatctctatcaaatttctttcatgtgtatgctatactatttcagggtattataagtgtgattgtccactgagtaatcaaatagtctttgaattcatgacattaggcatatttatggaagccatttccacactagggtagctagtattggtttaattatacacaaggaaatacaggatggtgccagggctcatgtttataatcccagcactttgagaggccaaggcaggagaatcacttgaggccaggagttagagaccagcctgggcaacatagcagatcccatctataaacaaaataaaaaattagctgggagtggtggcatgtacctgtagtcccagccacttgggaagctgaggtggaaggatcacttgaacccaggagtttgaggcctcagtgagcgatgatcttgccactgcacttcagtctgggcgacagagcaagaccctgtctctaaaagtaagtaaatacatacatatatacatacatacataaaagagaaatatctatgtgtgtatgtatcctatcatctatcattgctctattgatctagctatctatattctattaacccaagcttgacttcaacttctgcttacccagatttctaaaatgccctgcatactccaaaactgccacctcccacccctcacccctaaaaggacattatgatgaaggggaagttggagtggaatcataatagtcttcgccaattgtggttaaaattatcttacttctaatcattttataaaatatacaactatctgaacatattgcacacagcccttcctcgggccttggaagggtaacacaatggggatagactgtgaagcttaagcttcgtagctccacaggtacagggctttgaaattctcccacagatacacaagagggtgtggcatgtgcctggctctggcagtgatggatgtcctcatctgtagccatgccacatgtctgatggaggcacctgagacccatccagcatttaccaacctctactgcacctgtaaagctgtgtgtctcacctttctaacatcagacctcaggcaggagatgggctgggccttgggggaccagatcaccattattcacttgctttcacacaagcatgttggatttcaccttggggagaaaaaacattcaacaaccgggccagaaaacactgctattgtcgacagctctagcaaaacactgtaattcagacttttcctagtttgttaaaatttgctgatgccaatcggtatttcagagtctcgttaattttctcattactctcctattcttttctccctagcagcttcttccacgcctcaatcacacctttgaatcttttacagggacaccataaagctggttactttatccccttccatccctgcagcttgtttggctgcagatatatttcacatgaagccccaggccacatcagatgacagcccaaaccgcagcccccaaagaccatccagaaatcctgctgcacgcttgggagttcaaaactgttttgattcggattcacaagaatcaccctgatttcctcctatgagtttttacataaatttctcaccgcagcttctctacaaccctggaaggctcctccaggcaagccctgagaatagagctgtgccgcggttggccatatccatgtaccaggaatttgttgggaaacagcaaccagctcagtggtagaatcaatgaaaatttttatatcctcctttatcatttcctattttggggggaaaaactatgtaagatagggaaactctgttgtctagccattactgaaatcttaggagaaatgatgttgacaggatgagcttaaaggaaattcattccactggacttcccccaagtaatcgacagctggctatggggtcaaactaaacagatcactgagagtcacatacttgatctcagccatacattgctgtgagcctctagggaacccctttttctccacgcagccttggtgcccacaagagcatcataagagacaaacacacaaaataagggtgaaatcaaggttgaggtgattacggaacacaaaatcttctttgaaatgactttcaaaagaacattgtattagtctgtttttatactgctataaagaactgcccaagaatgggtaatttataaaggacagaggtttaatggactcacaattcagcatggctggggaggcctcaaaaaacttataatcatggtggaaggcaaagaggaaacaaggcaccttcttcacaaggcagcaggaaggagaagtgccgagcaatgaggggaagagccccttataaaaccatcagatctcgtgagaacttgctcactatcaggagagcagcatgggggaaactgcccccatgattcaattacctccacctggtctctcccttgacacatggggattatggggattataagatgagatttgggtgaggtcacaaagcctaaccataggaaacactttttttttaaatcatggtgactctcttaagaatctaatatatttatcttatatgctttgtgtgtcttagtacacacacagacagacaaagacacatacaacctcatagaatttcttagaggaattcaagtaagatgccaaacatgtagaaccaagaaaaacgtctggcacattttaagagctaaatatatactagctattattattattaggaatacagtacctataaaatgtattcataatttaacaacacacattttaacaagccataactattgacagatattaactagtaattattctgattaccctaaagtgacaaatactccaaatgcctactggcaccagtgcatttgacagcattgcattttttggtgtagttaacatctggaaaatgtatacattatctaggggcatcctccatatatttatttatatataaatctatgcacatgaatctgtatgcatgcatatgtcaggtttattcatttcaatctaattgcaaaaataacacatttttctccaaataatttgaggaaaatttaaaaacacaatcccctctaaaccgcatttttccaggagttgccactgttcatactgtgatctatggcttttgagactttttttccaacaacagatatgcacatatattttccaaagaacatttggaaccagaatgaacataaatctttgcaacctgcttttaaagtacattacagtatcagaaatattttcctagtttactaaatgttcttctaaaacccaattttaatggttgccatcctgcatgctgttaatttactaacccaaatcctcttttcttttttttttttttttttgctttcaaattttactacttataaggcaaggtaataaaccctaggaaatatccacatttatttccttgggataagattctaaaagctgcacttctaaggtcaaagggcaagcacaaattatatatacagtcaaaccatcttccaggacagttgttgcaattaacactactatctgcaatgtataagactgttcattttccttgcatcctcactagtactaagtatcatcactgtttttaatcattgtcatttgtcattttaattggtgaactgcagaggcccattagtttaattttaacttatttgaatattaggtgaggttgaatgttttttataagttcaactggccatttggcatttcctcatttgtaaactgcctggttatgcccttcactcattttatgattggactatttatccattctaatttgtaagtgttcttaatttagtaaacacattaacttattatctacattttcagttataaacatttctctagtttcttttaacctcttaattatttttggtacatgtacattgttgagtataaatacaaatcatttcccactctggtagaaatgcctacatagagtatcagatacttgcgtatcatactacagaagaaataaatattcacctgtatcattcttgatccttttgttaaattatgaatacatttaaatattgacttcctctagaaataagtttaatgcatgacatagtgtaagaatctaactttattttactttttaaaacactttcactattgtttcagcatcattaaaattatccatctactcccggatgtcctatatgaaatgcttataaatacatggctctatttctgagctttctattctgttccactgatctatgtgcctaaatatatcagtatcaacatgttgtaattattatggatctgaacatggcataattaatgctagtgctagagactagctcaggaaacagacaacctgagtttaaatgcctatcctacctcttactacggatggccttgggaaagtttgccaatgtctctgtgccttagtctctccatcagtaaaatagaaacaatcatctcttctttacaaaattgctgtaaaaattaaaacgactgtatggatacaaagtgcttaaaaaggtaccttacacagaatgaacactgaataaatgttatgctatatccatttctgaggagtgttataacaaagtgccacagactgggtggcttaaacgacagaaaggtattatcttacagttctggaagctagaagctggaaatcaatgtgtcagcaggattgaccccttctgagggagaagagggagaatctgttccatgtctctcccctggctttgggtggtttgctggcaatatttggcattccctggcttgaagatgtatcactccaatccttcatctttcctgcatctccacacattgtcttttctgtctccctgcctaattttttttttgtttttacaaggataccaatcatactgtatcagggtccaccctaaggacctcatcttaagttgattaaatcttcaaagacattatttccaaataaggtcacattctgagttactggggattaggacttcaaaataacttcttctgaggacacaattcaacccacaacagccattatttatggtaccttttcaagattgaatgatgaggttatcagacaacttagtcttaatagcaaattctatgccaatatttctaatttttcatgacaaatgatgacattaactttagattgagaaaagctgtttgtttatgtttagtatgataagaactcatctttcaatttccagttgtcccaagcattgggggtgttgggttgcttgctaattttaaaccagaatgagtgtgagatttttcaaaagcctttttgagactattgaactcatcatatggttttctattttttatttatccatgtaatacatattaattcattccctaatgttgaattttccttacaattgtaagataaatcctattgtagcatggtatattactcctttaacacaacactggagtagatttgtgtgttttgttgtttggttttgtttttcacagctacatccatcttcacttgtgtagttgtcctctatagtcccttgacaaatctcacaatcaaattgtctttgctttctcaggaaagggatttgtggatcagccctaggtgatcctcttcaatcactgtatctcctagaaatgactaagtatgaggcaaaagggtggtatcttttccagttcccaccctactcatgtcaggtttttatattttggtcatgttggttcatgtcaaggaaggtggggtgattagttgcctgtgctcaaatccccctctttcccagaagccgggacctattgcacatatttgtatgaatgactcatcaaagcaatcccagtggtctccacagtccgtggatccttaaaacccaattcaaaaaccaaccacatttgcatccatacaataaaatactactcagcaataaaaacgaatgacctattgacgcttgcaacaatatggccaagcatcaaatgatttatgttaactgaaagaagccagattcaaaggctacagaatgcatggttctatttatctgacatcctggaacagccaaaactagaggaaacacaaacggatcagtgcttatcaggagttgagggtgagggaaggatttgacaacaaaggaacagcatgggagaatttggtcgataattgaaaaaacacattatcaatacataagggataagtggataggggtatgggtgaaacaaaattggccatgaggtgttaattgctgaagctgggcaataagggcttattatgttattctgtaaaaaatccttaaaagtgtacagttaaaaaaaaaaaaaatacataccaaacattgcacccaatctgtgtgaggcaggggcttggaaaacatgacgctagggtaccctttaccattccaattttctaaacccttatccctctccaaatggcctacttcataaatatgctatccaatgattaataaaatgaaagctaaggagggaaaaagatataattaaggaagcagtcccaactttggccatctaaagtaaaatgactgtgctaatgtcgttgttaatgtttcgtggtcagagcaaagagaaaatcactccccagattacagcttttgctattttagggcctctctgggagccccactgcaatgcacaatgcggttcgaaatctgagcttccattaaagagtatgtttgaggcacggcttagagaaccccacaggaagactgcttagcctctcagaaaatgccctcaggcctggccaggctataggtaaggcctgtgggtccctccctgacagtagctggcccccagcaagctgccttctgatctgcataagggtccctgtgggggcctggctgctctcctggaccgggaaagactgcacagccacgtaatctacgtgcatcttcagagaggaccagatttgcccacacattctgtcccacacagctcagaggcatagaggcagccaccttaagagtactcctcacagctggggacaggtgaatcacggctactcagttgattggttatctatctatctatctgtctatcatttacctatttattttcagaaagggtctcactctgtcacccaggctgtagtgcaacctctcaaactcggccaatcctccaatcttagcctcctgagtagctgggactacaggagcacaccaccacacacagctaattttttgtattttttttttctgtagatacagggttttgccatgttgcccaggctggtcttgagctcctgggctcaagcgatcctcctgcgtcagtctccccgagagttctgggattacaggcgtgagtcaccatgcccggcccgctattgtttttaaatgccatttccctcatgagtgcccaattgttgttgttgttgttgttgtttttattattattattatactttaagttttagggtacaggtgcacaatgtgcaggttagttacatatgtatacatgtgccatgttggtgtgctgtacccattaactcatcatttagcattaggtatatcttttaatgctatccctcctccctccccccaccccacaacagtccccggtgtgtgatgttccccttcctgtgtccatgtgttctcattgttcaattcccacctatgagtgagaacatgcagtgtttggttttatgtccttgcgatagtttactgagaatgatggtttccagtttcatccatgtccctacaaaggacatgaactcatcactttttatggctgcatagtattccatggtgtatatgtgccacattttcttaatccagtctatcgttcttggacatttaggttggttccaagtctttgctattgtgaatagtgccgctataaacatacatgtgcatgtgtctttatagcagcatgatttataatcctttgggtatatacccagtaatgggattgctgggttaaatgctatttctagttctagatccctgaggaatcgccacactgacttccacaatggttaaactagtttacagtcccaccaacagtgtaaaagtgttcctatttctccacatcctctccagcacctgttatttcctgactttttaatgatggccattctaactggtgtgagatggtatctcattgtggttttgatttgcatttctctgatggccagtgatggtgagcattttttcatgttttttttgattgcataaatgtcttcttttgagaagtgtctgttcatatcctttgcccacttcttgatggggttgtttttttcttgtaaatttgtttgagctcattgtagattctggatattagccctttgtcagatgagtaggttgcaaaaattttctgccattctgtaggttgcctgttcactctgatgctagtttcttttgctgtgcagaagctctttagtttaatgagatcccatttgtctattttggcttttgttgccactgcttttggtgttttagacatgaagtccttgcccatgcctatatcctgaatggtactgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagcaaatcctttccccattgcttgtttttgtcaggtttgtcaaagatcagatagttgtagctatgcggcattatttctgagggctctgttctgttccattggtctatatctctgttttggtaccagtaccatgctgttttggttactgtagtcttgtagtatagtttgaagtcaggtagcgcgatgcctccagctttgttcttttggcttaggattgacttggcgatgcgggctcttttttggttccatatgaactttaaagtagttttttccaattctgtgaagaaagtcattggtagcttcatggggatggcattgaatctataaattacattgggcagtatggccattttcacgatattgattcttcctacccatgagcattgttatcaaaggaaaatctcaggaaaattgaacaaccagtgaaatagcattgccccctatcttcccatcaacctagaacagaagggaactcacctgtaccttggtacttgagagatgagacagctactactgcccccattttactgataaaaaaacaaagtgcctccagaagtcataactagtgaggaatgagcgaaagttgaggtgagggatggagatagttagctcttctccttcattctccatctcatacaaaaggaacttccgctgctgacactggagagggaagtgttaaaaacctttactctttcctccctgaaggtgtaggacttgctcatttgactgataaagcttgccattccttgggctaaatgtactagcggtcgcgtgtcccagaggtgcatctctctgatcctgcaacacttttgcccacctgagctcaggtgcctaggtcctctgatctgctctttcatctccttctgagttcttgtcttctttcagttcaggggcagtaagagctcacttggaaaatgatggtccagggccatcattttctatcctggagaccagtagtgagaggtcaaccagtgccatctgttcatgcaacacagtgggtgggtaagtcagggcagagctgctgttggcagggttgaacttcacccaagccctgtgctcctggttaagaaatccccccatctccaggtaacagcttacggcaaagaaccacctttccctgtacagcttagataagacttgtggatgatcctttaacaaggccagacacaggccctccaaattcctattctttgtctcagaaatgattagctgcactgtttgtctacattaaccaatctgactggatcaaattttagtcaggcttcactccttcccatgggccccttctaaggatttgctgaccacaaagaacatttccagtttggttcatcgatcaagccacctgctctcctcacccacgctgatcctgtccccattgcaaccaccccccttttcccattgcaatcattcccgttgataaaatctttccttactactgtacaaacttgcacatttttttgacactgtctctagtttagaaggaagggagacaaagaccaactttcatttgagagttcaaccgtttatgaggcatgctgcaatcaggggtcagacagtgcttgcccagatgaaaaggactggtggtactagcttcgagttttgtgtgtgtgtgttctgtcagatctccacagaaaagatgggcaaaaagctgaatctgggtgccctaaacacagcctgtctccctcttctagtttctttccactcctcaacaccagaagaggccctctcagctcatgccgcaccacctatgcaactcactaaacagtaaaacagattttgcatagcaaaggacatcagcttctcccacgtctcagggactaagggccaacaccaggaggcaaagcaggcaaatgaaagctcatttctctgctacaaaatgaaacacaaaacactcctggggaagagtccttctctgtaggcaccagggacacccatcacccctccagcctggggatcccccagagatggcataaagggacacccatttatttggtcgggcagctgggaattttaatggaacatcttaggaaacgttactacttggggctttgggctgggggagagctagatggactctttgtacttcctcttcttgaagctttgctctccttactccattgagtatggttgtgctctgtaatctgagcttcctttgaggactggaacacaggtctacagatggatgacaatgggattatgagacccagcctcaaagacatgagagtgatggctggtctgtggggctgccccagagatgccagctggaaaacgctaagagcaggtggccaagtccttaacaacttttccaaaaacaggggttctatgtgattccgacctggcaagcatagattcacatccataaaacattttgcagcacagactatgtgccaagcctgtgccaagtgttttgcaaatattatctcattgtatccccactaccaaaaagaaaaatcatttgaattaaagttacagagacttaatacagaagcagaaacctttaaaccttgtagacaagtaagaagaccttcgaattccccaccctcaaatatagattcctgtccattcatttacttacgaatgttccttttgttcattcttttagtgtagttcagtgaattttaaactgtagtgtgcatgagatttattcaacaaaacatattttatcatgggtgccataagagatttcctaaggttaatttggacaatacgcacttcccagcttaactgttgacttcagaggccaatccccgcctagaattctagtccactttgttacaacttctgatcatcacatcaaagcggggtggtgagccctggtacaggtggggcagtttgcattttgaatgtcctagatgatcaagaacatattaaaagaagctctttggctgtccctatcacttgcaatttaaggatgaataaagtgaatgagttgagtcagagacaagaacaaaaaataagcgaatggcttagcaacttgtgggagatccttgccacggaatattacccagcatgaactattaatatacgcaacaagatgaatgaatctcataaagcatagactaactgaaaaagtcaagcacaaaagactatatgccatattattccttttatataaagttatagagactgaaaaactgtagtatcaaaaagcagataagtggtcgcctggagcagggagttggcagggagggaagttgaggggagggtgataaaaagcaaaagggaagagagggagagaaggaaggggagggactctatatcttgatgggatggtggttacatgattgtgtacaatgaccaaaattcactatgctgtagccttacattttaaagtctaaaaataataccttaatacttttttttttccaagaggagaggaaaaaaagtcatggtcacatacatacaaaaagattagaacactttattccaaacaaaacactattgagcaatttgggtcaaaagaatgcacaaagcagaatcacattcttcctttcaaatttctcctttcacatttgtgaaagaagaggaaaaagaaaaaacaaactgcagcatacatttgaatttttcctttcagagaggggctctaatcagtgcagagaactgggtaacaagtaagaccaagagggtttaattaaactgagcaatcattaaactggatttaagagtgcttgtgtttgcaaaacaacaaaatatttacagacattttcttcatccccttcattagtttcagactccacaggaaatatggaggttgggaacaggtcctaatgagatcatgcaaattttaactactgaggttagcctggcaaagagacagcacggcaaaatgctcatgatgaaatgttaagtgaggaaagcaggatagaaaatgagcttgcactaacattatgagtgattccgataattataagcatggtagggggatgacaagcaggggctggacattaaaatattctatcagtgatggtacaagagcgatggaattaggggattattttcatctctgttttccaaaatttctgaaatatatgagtgtattacttttatttctttcaaaataagaaggtacactaaagcaagaccatcacttgaggccaggagtccaagacaagcctgggcaacatagtgagatacctacagaaaatgtagacttccacacagtgagatctctataaaaatgtagatctcaacatagtgagatctctacaaaaaatgttaaaagttagctgggcacgatggcatccacctgtagtcctagctactcaggaggctgaggtaggaggattgctggagcccagtaactggaggctgcagtgagctagcattgcaccactgcacttcagtctgggcaacagagcaaatccctgtctctaaaataaaaacaacacaaaaattttctaaaatctaatttagacatctaacagtcatacatgttcactatctctttgctgtgcctcagaacgagacaaaaggggaaggaattctgtaatctatagcggcagcatccgatctcagaacactgcaccttcactcactccaatcagggtcttgctgccactgggacagtgaaactgccctcctcaagaccacccatgaccctcatgtagctgagtccagaggtgaattcttggccctcatcaaacttgcttcatcaacagggttaacagcattgatggctccctcctcctttctcagattccacacagcgttctctcttgcttgtcttccacctactcttttgagatggagtctcgctgtgtcacccaggctggagtgcagtggcatgatctcagctcactgcaacctctgcctcccgggttcaagcaattcttctgtctctgcctcccgagtagctgggactacaggcgtgtaccaccacacctagctaatttttgtatttttagtagagatggggtttcgctatattggccaggctgatctcaaactcctgacctcgtgatccacccaccttggcctcccaaagtactgagactacagttgtgagccaccgcgcctggccctccacctactctttctcagcctccatgctggactctctccctcatcttgatacctacctggtggagtgcttaggctcagtccttgaatttcttctcttctaagtcccaaccctgtgcatctcatctaagcccacaacttgaaatagtatccatacactgactactcccaatttcacatccttattctacacctctctcctggactcaggcctgtatatctaactgcctagttgatgtatcgacctggatgtccagtagacatctcaagtctcacatgcccaaagccaatatcgactactcttctccaaacccgttcctctcaatcttcccttgcttggtgcctcagcatcccttgtaggtttccttagtcttgcccacaccactaacagttacttcattcaattctcttcgttacacacttttgagtagaattctatgtcctacaggaatcttgattgtgttccatctaggatgatgcccttggagggcgagtcctcccctgctgcttccatctgccccagaagtcacacctcagcctagattagctgagggtcactcaaacgcactgtagtctgtaatgcccttcatgcccttatctttgtatgcaggtgaagcatagaccacccttaccctgctgtctcctcacccttggaaatggagttcaagtatcaagcctccctcaggaaaatcttccctgaccatcgctcccaccccaagctaagatggcatcccacccctgtggttcccaacacttcactcatggctactttgcgaatggtcttatagcccatctttgtagacacatgaagctccatgatgaatttagggaggcccttcagcactccacccctgccccatcacacctgctggtgccaattcatacctgtaggagagccagtcacacctgcagcatgttcagcccctgcacctggagaaaaaacctagcaatccagaactttaaaggtcacttccaaggacttctgggttcacaggtgacataaataagcaaagccacagattgggtaggatgttcaatgaaccaaagaacacaaatcctatctgaaggcatccaaaagcaatttttaaagaacactgtatactcagaagaagaagacaatctgtgcattgatctgggctcatggtccgtgaatttgcaatctctaagccaaatggccacaaagtacctaaatgtgcaagacctcgcagattaatactgaatgaaggcctcctgacaggaaatgtctgcacattactttccaggtgacagattggcagataaagcccacgcgccactgtctaagtgacaacacacttttcacacgtatcttctcagtcatcctcatcatagccccaggagacaagttcattattatctctattttgcctttaagaaaaccagagcctgaacagggcagatgacttaacaaggtcacacaatgaggatctgaaagagccagaagccctggcaccagtcccaggtactccacgtgcactgctgggccagtggatgcttcacaacctgaaggatggccagggcctcttgggccagcagtgtccagcgtcatcaataccctatccacttcaagatgaatgggacatttttttcttttcttttttttttccttaagacagagttttgctctgttgcccagcaggctagagtgcagcagtgtgatctcagctcactgcagccttcacctcctgggttcaaacgattctcgtgcctcagcctccccagtagctgggattacaggcatgtgccaccatgcctggctaatttttggtatttttagtatttttagtagagatggggttttgccatgttggccaagctggtctcgaactcctaccctcaaatgatccacccacctcggcttcccaaaatgctgggattacaagcatttgctaccatgtccggccagatggcacattcttaatacatgctatgaactctcacaagaattcccatatcatgacttttataacctgccttttaacccttccatttaaaaaaaaaattatagcatgtgctacaaagccctggatgatctttgggtttaaagcagcatgcagctagctaggaaggccatggcatttgtgtgtaaaacagccttctattctggtaatggatgcagccgcggtctgataagcaggctgtgcagcattcactagcatctgaggccagcattcaccagcattgtgaacctcgggaagaaaactcaaacaacctgatgtccaacagtactcctataaggagcaaaattggtgagaggagcccacacttttcctaaaccccatacaaacatctctatctctgccatgatggcttaagcgtaagtgaaatcactttgactcacatcctcaaggtgaagaaagctgagctcacacagaacggctaatatgtgcacagaacatcacagctggcaaatatcccgatccgtacatcaatccccaaaaccagctgctgttaacctcacttttcagataaggaaatggggttgagagagattagatgagttggcaaaggtgagtggagatttgatcacaggtcagctggattcacaaatctgtgtacttagggcctcatctgtggttcccaaatttcactggtcatgtacatcacctgggagcttgttaaacgcagattcttgggctgtgctccagggactctgattcaatagttcaggggttggacttgagcatccatttttaaagagccttccaagtgaatctgatgcaggtggcgcattgtccacagtgtgagaattactgcggctgcattgagcctttcaaaagagagaagcgccatcctaaatgaaaaccttaaagccacaaatgatgagaatcaactcccagaagcattcccgggtctgtgagcacagtctttgcagaaatgctggcttttaggcatgcttcctaaactctctcactcctcatgacacaagcttttccaaatgctagtagcacctgtactaatatttagttaatattttttaatatgtcatttttcttaacttactttaaaaggaaactccgtatcactaccaaaatgaaaacctggtctcatttgctataaacacataatgaggctaaaaacaaaattaacaaaaacaaaaacataagtaaatgttggctagatattgttgctcccctagggttctgaccctagaacatggttcctcctagggaaaaatgagcatttgtaagtgttggaagggcaaggagtgatagaagctctaaaactcagaggctctttttatataaagaggtattagaaaagaaatgaagcattttctccatggaattcaatgctcatggatgccctgcccacacactacaaaaaattccatgaaccaccagtaatgtcccatatttcgggtgtcattggcttgaggcagtgttttcaagacttgagggtgaatcaaaatcacctggagaatcattcagattgccaggccctgcccccttgggtttctgattcagtgggtccggggaggggcctgagaatctgcatgtctagcaagtttccaggtgaggcagatgcttctggtccagggccatgccttgagagaattcagagcagctgaagaaaagagggcttcattccctggcactctctgatacctacaaggagctgtcaactgcacatgagtaccttctggtactgcacagtccctttgcagatttccgaccccagacattcccagctccatataaggtctttatcaatcacttcactccaggactcttctggaagccccctctaagaggggctagaccctgccaggtaaagcttttagatgggccgtcccctctcagggggtgtaggcaggaagttgcccactgactcggggctgcctcaacagaccaggccagcctgtgggtctgacctgcagagggccatatcccaccttcagacctgttgcctctatgcagcaggctctgcacctgcctgaggggtcatttctggtgggccctctctccctgaccaagacttagccttgctctgatgtcaagcctccctgcatccacccctctctcctgttctccatcctggactaccccagagccctgatactgccctctcccaggtcacaggccccaacaatgggctgcactagctctgagcttctccccagcaggtttgagtagcaaataataaatattttttttctaagcaactcttagtgcaattcaccccactgtgccttatgtttgaaggagcttatagcaatcctcaagggatccaggacgacacgggggacataatttagaggggacagatattcctccaccagaagtactttccagagaatctggggccaagactctggctgtgccctctggtgggatgacttccctgagcagagaatgcatagagtgcatcagagccacacacgttccagggtccatagagctaggttaaaatcccagcctctgcttcctccccgtgtgcccaaggacctgtttctgaacctctccatgtctcatttcttcatgtgcaatacagaggaaatcatatttgcctgcatgattgttgtggggatgcaattaaataatacacgtcaagcctcagcaagggggcagccaggcttacaatgcatccccaagaaaggacggcagctgccacaaatgctgccatcattattactgatggagcagccacccagatgggggtcacttcaactcctgctccaggccatcccagagatggctattaccagggaaaggatgtttccctgctggcacacacacactcattcaagatctcagcagccatagaagctaaaacaacatgggttgggatgtgcaggtggggttgtaaggttgctcttgatgtgactttcgatgtccaccaaggaaaacctgagggtgcaggaaggaataaacaaatccccttcatccaggacttcccatttgccctcaggagtaaggcaggtgttggcagctcccagagctgaagccactgcctcataagttaatgggaagagcaaaaggcaagacctgcttaaggggaccagcagaaagattgtagaaaaaaggggggctgggtgtggtggtgcacgcctgtaatcccagcactttgggaggctgaggcgggtggatcacctgaggtcaggatttggcgaccagcctgactaacatggtgaaaccccgtctctactaaatacaaaaaaattagacaggcgtagtggcgcatgcccgtaatccaagctacttgggagactgagacaagagaatcgcttctacctgggaggcagagggtgtagtgagccaggatcgcatcactgcactccagcctgggcaacaagaatgaaactccatcaaaaagaagaaagaaaagcaagaaagaaaagaaaggaaagggaaagggaaggggaaggaaaaaaggaaagggagctactcatggtggtgtggtagacccacgcctgcagtcaaacagaccagagttcacagcccagcaggtcactcaccatcagcatgcaagtccacgtgggacttcacctccaaagggctctgtttcctcttctgtggcccaggtatggtacagtgaactgagctgtcaggggcattaactaaaattccaataatacaaacagacgcttcctaattaggcatgtaggttgtacttagaccactatgtattatttctcctcattttacagagagatgaagtaacttgctcaaggtcacacagtcaacaaagaggagagctgggatctatacccatgcagcccacctccaagtcacatgctattggctgctaagcagcaccgtgtagcacagggcctgccatgcagcagttgtgagtacaaactgggacggggtaaggaggcagggaaggtgaaggttgctttcccaaagcctctatctggatgatgagatgggaagtgaatctgcagactcgattaatctaaacccaagctcattgcacaaggctctggttccctgccccaaatttaaacagctgctccttcaatgtagtggaacacaaatgtctgaagagctttgaattttaattatcacagtcctgatgacaatctgaatcaacagctgctcccagcaaggtggccctcagagatgcccagagaggggcagagggaggggacaggaggacacagtccagacaggacacagatgactgcatctgtctggggagccctgacacctgcagctgggagctgtgggatggacaaacaggttgaaatgcagtaagaggaggagggaatctctggggtgcacctgtccccttgccacagaacatgtgtgtctgtcatatgtcggggtgagtgacaatgcagagggagaatatcaggggccatggggagaccctaccatggtgtttctgatgagtaggccaggaggtgtgaatacaattgcccagggatccaagaaggggtcaaaaagaaaggtgtcagagggatggtcaaccaactaagaggtggcaaatgacagccctgctgtgacaataactcctatgttccaggtattggagcctccacccatccctacccaccttctcttctccaggtgagaaacgtccctcccttcctgcaactatttcagggaagacgctgccactcaacacaaaaacctgtccccaattgcttcaatgcaaaagagaaggacattccctccaagtactgaccctgtcagtcccatcttttgattcctgtcatatctaacacctttcttaccagtgacattgtctggataaccccaaactggaaatactagaataacaaaatggccaggagaacagaacataccccctgctttctttttggctttgcccatcaatttggcaagatggcagcagagcaggtactgcaggtaagacagtaagtcaccacaagatacccagaaggaagttcggacacatgtgtcatttctaacatccttagcatgcgagagtaattctctcctagggagatattttgtgccttacatgcaaggatactcagtgaagtgttctttacaagaatgcaaaaggaattcaaaaacaggagactaattaaataagttgtgatacactcacgcacttgaagtgcgtgtcattatcaataatttagagttccaaagagcccgaagtgtggagacatgtttacaataaaatgttaagtaataaagaaggacattaaatcatctgtcacatgtataattattccaattgcatttaaaggacagaggtgtataaatatgaataggaaaaaatacaactaaaagaaagtgcattaatcatctctgttcttatggatgggttttattttttctgtgtgcttcttcctattttcctaagttttctacagaaaatatgcattatatagagactttcaaatttattttcaatttaaaaattaataataaaagaggacagagaagttagggaaggagagatggtgttcagacaagggcttggagcccattttgaacaaacctggcctcattctcacagccctcagagtcaaaatagcggagaacattttccccttaaatcaattctgcaaaataatatttggtctgatgtttgtaggaatacaagcgtccttggctcctgcaagcgtggatcagacaaagcaactcaagaacccattcttgaaacctaaggattagcagttgccatgacaatgtgttagcaaacaatttattaagtacttgaaatttctcctccactattgattactaaatgggtattggaatgacccattactgcaagttctgtgtccccatctcagtgcctgatctggctgcaaatggtcccccaattaggacgcctggctgtaggcggctgccattcaaatgcttggttcccatccaagaaagcagtcatctgggaaaagtttaagcataatctctccggactagtttctgataaaggagggaagaggacagggaaaggacttggggagtgcttactgatgatgaggaagatgagccctgctttggaagcactgacaacttttgacagcagcctgcagcatcagtgagatggaaaaccacccaactgccctcctaggtccctcttctgatgccaacatcatcatcagctgagggggctggatccctgccactgcaggtctttgtttcagaagatttgggcccctggacattcagctccatatcattcattcaacaaaactccactaagagcacttgcaatgtgatggtaccaagcaagttccctaaatgcctcaagtcttctacccttgtgcacaattccctttactttttttacttatttctatttaattaatttttttttttaggaataggatcttgctctgctgtccaggctggagtgcagtggtacactgatagctcactgtaaccttaaactcctcagctcaagtgatcctcctgcctcagcctcccaagtagctaggactacaggcacaggccaccatgcctggctttttttttattttgcaaagacagggtcttactatgttgcccaggctggtcttgaactcgtagcctcatatgatcctcctgcctcggcctcccaaagtgctggaattacaggcatgagtcaccatgcccagaccctcatacataattcttgcgactttccctctctattatgaaacaaaactttataccatagctaccacatgtacctttcagcaagtagcaagatacagctgccaaataaatgagctgagcttatgataatagttgtagctggtatctagaatatagaagctttaaacaaacaacaacaacaaaaaactccttatctttatgctgtttagaccaatcaaccttcctccctcaaccccctccccatcttagccaccaccaccaccaccaatatccctggcagtgcattaactttgggtgccaagctctcagaacaggagtgggggtaaggagttagacttggacaagagcagggctaagatttgaattatatcccctaaatattcacgtgttgaagctctaacccccagtgtcacgatatttaaaggtaggataagctcttaaaaggtaattaaggttgaatgaagtcataagggtggggtcctaatccaatgggattggtggagggtgagagatctctttctctttgtacacacacacttaggaaatgccaggtgaggacacatggagaatcaagtcaggaagaggcccctcaccagagagaaaactggccagaaccttgatgtgggacttccagactgtgagaaaataaatgcctgttgtttaagccacgcagtctatgcattttgtcatgacagcacaaggtgggagccactgcctcccaaatgctgaagaactagcacgttggctcagaagagaagtggagcctacgtgggcagagggtaaggagatggttctgctcagaatgaggtagaaccttctcatagaagaggcagagcaagcactgtgcaggcttctaggagacaagagagggagcgggtgagcataccatcactaatacatgccgctgcaagatcttccgcatcagatgggagttagatgagaggacacagcgtaggcgctcaacaagtatttgtcaaaggattgacacattttctttgtaactggacaccaggcatgcacagagacaacttacagctggttagcagtggggaggtaggtgccagagacatggctgataccagtaaaccctggaatgatagagtaaaggtcatgtccagtgattttcatttcagctacgtggcactaaaactcatcctgtcaacatgtgtcctgactgaatccatcccagtttgcacatgcaggctggaaaccactatctgaggccacagcagcctccttgtcccatgaatgccacacacgggcctggcttgggcgtgagtcctgcaagttcatcctgtcagagggtgagaaacagagaagcaggcccacacgaccaggggtgactatgagaacacagggctgtgcaggtgcctggggcacacagaaggcagggccccatccctgaggtgccaaagacgtaggttagaactgtggatcagggctagagccaagcctaggggaaatctggacctccccatgaggatcctggactcaaggaagctctgataaggcagacatcacttctcaagggggcatgtgcctggtctagaccaagagatcagggtctggctgcagcgcaggctgcacgtgaaggtgtcaggcctttaaaaggtggccggtgcttatcaaggacaaagaggacagagaactaagctgcagcccagaagaagagctccaaaagtcagaatggggtggtttctgaaggtctggctgagaagcaaggtggaggggtggtggtaagaaaggaagagagccttgtgtctcccaccctaggtagcatgtcatgttgtgcaccctggtcagcgtcaccctgctgacttgggtgaccaacgtgtcccagttttccaagaactttcccagtttctgcactggaagccctgaatcctggcaaaccacgacagctggtcaccccagcaccagcccaggctctggcgggggcttcactgagctcctggagaaggaccttaaaaatcctctatccaccctggacacctaggttacttctgaaacaaccgctccaccttcacgacctcctcaacaggcgtctactgcctttggaattggatgctattaatacaaagagaaaaatgcaaaatggcaagcagtaagtatacttcagagtgataatgaaacaagggtcctcatctttgcagcattggtcagcctgccctcattctcacctcttccaacctctcctctatagggatccttccaaaccccaaatctgaccaagcttgccctatttggacccatcccaggctccctgttgctctgagaacagaatctaatctttaatctggccctcaggctctttctggaccagactcccccatctgtctggcctctttcctgccttgcacccaacagccttgcacaacttttcaattcctccagcctggccaagctaattcatacctcagggcctttgcacaggccaaaccttcagccaagaatgtcttctgctcccctagatctttatcctgccacctaccaacccaatttatttgcctgctcagaaaggcctttatttatcctccctagttccctgcaaataggatcaatttggtctcccacagagcacaagccttcacttcactgtattgcaatttttaaatatatttacatgtttgtgggccacctcactcttccctgaaccctttgataacaaggactggaatctaactatgtttttccagtcccgagcatggtgccgggcacaaagtaggcatacagtgagtgtttcctggtctattgattgattgattgactaaactcacctcccccaaacccttcaatgtgagaatacattttcttcaaagtttttagccattataaatgacagacaagatgtctctttgaatttccaaacgcttatctcaaagcttttagttttgtctaccagctcatgccaccaaccggatgagcctcagcaaggttcctgtcaaagcatccctctttttgttgatttactttaaaatgcaactcagtggcttcaagtcagaagaagaagaggccacgtcttcagcctctccttaagcatctatcaccagccagctgagaagatgtgactgtcatcctcccaacccgacaagatgatttttctcaaccataatacaagcccagtgagccatacaatcatggtgaatcccctatcagctcaacatcctatgcaatttttcagagaatatgattctatctgaaaatacatgcaacagtctggaactcatttttccccagtgcctaactttcagattcctataaataccagatggccttccaggcagtgacacacgttggaattatcgaacaagcatcgcttatgactttgccttgggcagtgtcaaaaggtactgagaatttacccatctcattacggcgttgctaacagggtctcaggcagtttgctgggcctggaggtgtgtcaaattgcagtgccatgaatgcctcaaacgagagacagagaaagagaaagagaaggaatatgtgaatgtgtgtctgtagctgagggaaacaacaagagtaaagggaattaaactcttttaataaaggaaaatagttttcaaacaaagaaaaagaagtctaatggttagctactgctgcataacaaaatttccctaaaactgagcagtttaaaacagtatacatttattatctcacattttctgtgggtcaggaatccaggcagagctcagctgggtcctctctgtcagcatctcacaaggctgtaatcaagatgtaggccagggtgtggtcccatctgaaggcatcactggggaataatatgcttctaagctcactctcagggttgttggcaggactcagtttctcaggggttgttggacagagatattagctctgaactattgaccagaggcatccttcagtcccttgccttgtgagtgtcgctatagagtgtctcacaacacaccagcttgcttcatcagcaagtaaatgagagggtaagagaaagcaccagcaaagagagaatgctagcaagatgaaagccatagccaagcatggtggctcacatctgtaatcccagcactttgggagaccaaggcaagtggatcacctgaggttaggagtttaagaccagcctggccaacatggtggaaccacgtctctattaaaaatataaaaaaagaaaaaaaaatctgggcatagtggcggtgcctgtaatcccagctattcaggaggctgaggcaagagaatcacttgaacccaggaggtggaggttgcagtgagccaagattgcaccactgcactccagcctgggcaacagagcaagacttcatctcaaaaaaaaaaaaaaaagccacaaccttttgcaacctaatcttggaagggcgtctcattgcttttgccataatttttttttttttttttttttttttttttttgcccaagctggagtgcagtggcatgatcatagctcactgtaacctcatattcctgggcacaagcaatcctcctaccttagcctcctgagaagctgggactacaggcacgcaccagcacacccggctaatttctaaattttttgtaaagacaaggtcttgctatgttacctaggctgttctcaaactcctggcctcaaacaatcctcctgccttggcgtccaaaagcaatgggattacagacatgagccactgcacctggcctgccataacttatctttagaaacaagtgtctaggtccagtctacacttgaagggaagggattacacaaaggaacgaatattcaaagacagagattattgagagccatggcaaggcctctttccacagaaaggcttcagaaaattatgatcagagcctctctcctaaggcctggaacataagagtatctgggatattcattcattcattcatttttcaaaaagtatttaatgactgtctgctatggaccaaacatttctcgtctagtccggtctagtctagtccagtccagtccagtccagtctattcttctattctattctattcttaagatggagttttgctcttgttgcccaggctggaatgcaatggcgcgatcttggctcaccacaacctccttctcctggattgaagtaattctcctgcctcagcctcccgagtagctgggattacagcatgtgccaccacatctagctaattctgtatttttaatagagacagagtttgtccatgttggtcaggctggtctcgaactcccaacctcaggtaatctgcctaccttggcctcccaaagtactgagagtacaggtgaccaaacactattctaaatgctaagtgaacaaaggcagaagtgaacaaaacatacaaaaatccttgtcttcataaaactcatattctaatggaaggagaaagaccgtaaatgggataactagtgtgttggatggtgataacagctatagagaaagcaaaacaggaaagggaatgctggggaaggggtgggggcacaggttgaaatcaacaccacataggaaaggctccagtgagaaggtaacatttgagcaaaatcatgaaacaggtcaagaagctatcacatggttgtctgggggaagagcatttagacagaagctgcagatgcaagggtcttgggacaggagaatgaagccaggggctgcagtggagtgacaagagtagtaggaatacgtgaacagaggtgtcatgggcatatcacggaaagcctcataagcatttgtaaggactttgttttttattgcaaataagatggaaagctactggtggggggtggcctgagacacaggagtgatataaactgtcttatagcttaacaagtctcctcttgactatggggtggaagaccaatgtcagtggggtgacaagggcaaaatgcaggaattcactgaggaggctgcaggtctactctagatgagagccaatgatgacgtaatctggggcagcagcacaggaggtgggtaggttggcttctggatatattttggaagcacagcctaaggatttgctgatgggttagatgtggagtgtgaaggcaagaaacaaagaaataagacatagttctaatgttttggccctagcaactgggagaacagaattgaagattcgtttaattctaaacgaagtaaagaccaagagttcagttttggaagtggtagaaaactagggtgatcattagatcaaagttagaacctctgaaagcctcggccctgcatctgggtgatggaccgtggtccacacagcacactcgagcctcagtttcttcactgtacctgcaagtgcctaacacctcctaagtcccacatttagccagcagcccatccctgcgcagtgggaatctcggctttacacgttatgtgcgcatatcatattactgtacaataactcaagtcttgctatataggcacatcataaaactattccaagaggatagattacttgaaaccagcatttaatgtgcagctattacatgccaggcactatccaacgcactgctcctacgttatccacatgcatacacaggcactgggtgtcataggatctctagcagtcagagactgtggctctcaagctccttggcagtaggctgtggtcatctttcccacgtgtgcctgtgtttctctgcattaagattttcagaaatgagggccatgtctgggaatctgtttactactgcagttatgctgagccagacagtctctccctgtaaacttgcagtgatgggaacctcatgaccccataaagcagccccctccaatgttacagctagttctcagaaagtctttcccttttattatcagccaaaataaaatcctatagtttctattcattggctccagttcaccttgtggagccaccagagaaaatttcccctgccttccaaatcacaagctttcagagagttgagagcagctcttcaatcttcatttgacactgatgagaagagtgccagctaaaatctgagacatactctgtgaatcacacttggtaaaagtgtttttacaaatattatcccattcaccatccataatcactgaagattaactgcgaagtatcatttagctatcacttctaaatgggagaatgaatgggaaaactcttggaaaattttgagataattacactctgtatcattgttcccattctgcagatgagaacacaagtgactcagatatgctaagtcacttcaagattacctttaagtaactagtgttaaaagataatcttcaaaacataataaaatcatgactcatacagatatgaaataaatatgtgttaaagattttatcatcaatgatttatcaaagatcttatcaatggatttctatcattaattaatgaagattagaaagatgctacaagtggtttaaaagagaacccaaagaacagacagctaacagaaacatttaaatgggtgtacgaatggatgtaaaattttttgagggggaaggttgggtagctcagttgaacctctactggacaggatggaatgtgcatatcagtatctgtaactcataaaactgtaaaacagtttccataaaatcaaaatcagatacccaggaaggattacccctagagtctagagctagacaattactgttttccaccgaagcaccattttctctcacagcctagcatagctagggtctgcacatggttctttataactctttgccctctaagaaaatctgtttaaaacattcactgactttttttcaggcccaatcataatatagatgggccttcagtggctggcaacatatgagagaaggagcagaggcactgaagaagaaagagtttggcaaggacagttaagttcctgcctctctgcatttttccatgtcagtaagagcctttcccttcctctcttccccagcctgtttctcacttaataaggagttgtgcagggtatttccagcctaactccctcccccccatgcttgctagagagtgctccattgtgcaatgaaagaaggtaaggagttatgcatgtttttggttttactgaaagtctatagtgtttcaatagtctctttgttctctctctcaatagttcctgtgtcttaagaaattacaaattttcattcttcctatggcattagtagtttggaataaaaaaggaaggaaagaaaagaaaccaattaaaaaataaagtgcttaggcttaagaacagcatttataataacttcacaggtctaacctgcacttactggcggcagtttaaacagaaggttccttgagaggtgagcaataaagaagccatttagtacttgatctccagagagggttttatcaattcacttgcccccttaaccatcactggtttctgtgtaatccatagaaagatgagacaaaccaaccaactcgctcacatttgcatgggtcagacctcttattaaatgagttttccccaaatggcagtgcttagcatactctgatggcaaatgcttaaacatttcgtcaatttcaatgggatgtcaatttcccctgccaagcaaggtggccttccaggctaatctggggtgagggaggggagccaattccaaagtagagaatgattctgaatacatacagctttaattccaggtttgctcatcactcccgccatctcagcccatgcttctaccaacactggctcagaagttggaaaagatggagattgtatttctgttagactgagaggtggagcttgtctgtcttcccccctccttttcctttccttcttgagggcaaggcctatcttgttactctctgtacccactgtctcattcagtacctggctcatagttggtgttgagacactgttttttcggtcaaatggaactaaatccattgttttgtctttttcattccttcatctactatttacttgaaacttactagtttcaagttcaggttctcagctaagagctggggccatggcagtgactcaaacaaggtttttctgccttcaaagggcttatattttagtaagaaaaaaagacactaaaaaatgagtgaataaatgatattattattaatgatagcatttcaagtacaaataaggactcagaagtaaaaatgtagggtaaaatgatggagtggtagttttgacagggaagataattcaccttaccttcatctgtctatctaataaatagataaatagatataatcttatccattcagagggtacctgttggacagaaagatgatcttcccactcaacaccactattctgtcacccactgagagcaatggataagaatagactagaatttattgagtgtctagtgtgtgtcagccatggtgccaggcttttaatacataatatctgatttaatctttaaaatataatccccccaggagatagtccttattactttagttctaccagtgaggatacagaggctcgaagtcattaaagtaccttatctgagattacctatctatattgcctgatgtctccacctatggtggagccaagatttgaatatagtttcttctacctctgaaatgcacactttgtatgttatactttactggctctggacctgaggcattatgccaggtattctgggggatgtaaaatgttcagttagcagcctttgatgttgtcaaagagctcacaagctcactggggaaatgagttgtattcgcatagccataaccaaggaaaagaagacatgtatttcaagagagataaaaactgatgggctagaatgaccagaaaagcaacatgaaagggtaaaatgaatccaaaaagacaggatagatatgaaaatcagagatgaagttgaagaggagatgggagactgtttatacattggagcattgacagtgtgttaggcacgtgagtgatacagtcatatgtgatgtctgctcttaggtgggggaaaaaaaaagaaaaaaagctcacacctagctcagacacaagggaaccagaacatgatgtgcatctccctggggaagagtccagagagccacagtatgcttagcaaataaaaaccccaccatatggttttatcttcccatgaagctgggtacatttcagcacacaaaaaaataggatttcagctgggtgcggtggctcatgcctgtaatcccggcactttgggaggctgaggcaggtggatcacaaggtcaggagttcaaaaccagcctgaccaataaggtgaaaccccacctctactaaaaatacaaaaaaattagcaggatatggtggcgcgcgcctgtagtcccagctactcaggaggctgaggcagaagaatcgcttgaacctgggagacgggggttgcagtgagccgagatcatgccactgcactccagcctgggcgacagagcaagactccatctcaaaaaaaaataataataataataataataataagacttctgttatgcggttctaccttgagttccttaaattccatagattttattcctaggtaagtctggtcctcagcaaaataaaagtggagaaaaaagcttcaaagcccactcagctggaaacagcttacctctcagagctgcagtttcctcatcaatgaaataagatggtgattcaaaggattcaaaaatcattaagattaagagatgtcatcaggcaaaggactttgcatagtacctggcccataccagatgctcaataaatgtcagttccaatctccctccccttgactctccttttctgtaaaatatacctggtcatctagaaaatttgcaattgtcttgcctcttccctacccctttttcaatacagatattcaatgggtcataaagtcctactaattttcctgttcaccgtttcattcacaaatagtccttcttttcattcctctgactcctgatctagctcagttgctatggcttcttaacctgactccacgctacatgtttgtaccctcccgtccttctgggccccagatcaaccatcctaaaacctcctttaatgatgtcactagtgagacagcagaaagagagagatgggacttcaacttcacaggctgttcttagatgcccaggttggtcgtgaactccttgaggttaggaaaggaactattagcaaaatggaacatcctccaagtagaaaattatgctgatgtcaaacaatttcatgtagctttaatggatgagaggcaacatgatattgggcatgacatgcttaaaaagcattgctttcagtggcccagaaagtgtcataaaagaggccacatcaaagtagctcttctttagcacattacaattgagaagtcattcctcccattaaaaaaaaaaagcaaaatgcaactctttacaagggataggggtaggagaaaagggttgagcccggaagaaagaatactcaggctgcagaaacactatggctgtagttggagtgaaatacaggccacccagggggagctgctgtcctgtgaagtccactgatagaaacccgattcccaaaatatcatgcagtatctgcagatgcccagctcaaagacatcctgaaaatagtacttgttatgccatgtccatactggctggctgggtcaagaggaggatggggcactgggcaaccaacaggaaaggtaggtcattttaacacccaacccatccgcagtttccagagaagaacatatacaaacaaatgacacaagtgtggtatttctagacaggatatgcactgggcttaaatttcttttccctatggaagccttccccatccaaaaacagaacaggctgggtaccccaccacgtgttcttactacacttcacattcatagcctttattgtttttgtaattgtctagatgtttatctaaagtctgtctcctcacactagactaagagtgaaaggagagcagaagctttatctcgttctctctcgtatctctggtagtcagcatggggcttggcacttggggaacatagtatgggcgtatgattgctggctctgggtttacacaggctaagttcaaaccctatcttcactaactgtggctaaatgacctttagcaagcggccaactcttccaagcctcaatattttatcctcgaaatagggatattgatggtactaaccatcaagttgatagaggattttaagaattaatacatgtagaatatttaggtattccccagcatataagaagtgttcaataaatgtctattattattaactactttggtcaggactccataaatactcattgaattaataaagaaaagcttacactaattgcatattaaactctgcaacagagacttggcatccacagatgtcaatatttagcacttccactttgcatgagaagggccaatcgtttgttgtcatttacagtttttttgtggaaaccatttcactcatccatttatttagatcaaaacccaaacgcaacttgaggaaaagagtctttcaacaggggttcacacctcagctaagactggcattccaagaatatccaggcagacagaagccgagttgcctggctgccaaaaaggctgaggttgggaaaatgtcacagtgtggaagatgtcccgagaagtcccaaacactcaatggatatcatcccagggcagtaagatcagagatcatcagctcctggaagtgacccatccgctctaaagccaaccatttttggggattggcttgtgaagggatacgcacgcagagccttcgggtcagaagcttgtgcccaatgcctaaagttgagcgggtgcagggaagcttgacctaatgagaagagctgtccactgaagactaagttactcttacttcccctcccaggtgccaggcatgagcagcagcagcctctcctaggacacccctacccccgagtggcttcagtcctctggaatgatgcaaatcaggcacagggatgaggaagcacagcctccaactcagcctgaatctttcactttcctacaaccccttcttcctccatgagggatctgaagccatctgcttcaccatacaccatccagttaatctcgttcaacatatagttcacctcaacaaaccttcctggggcagggcacagtggctcgcacctgtaatctcagcactttgggaggccaagacaggaagatcattccagcctgggagttcaagaccagcctgggcaacatagcaacaccctgtctctacaaaaaaactgaaaaacaattagcctggaatggtgacgcatgcctgcagtcccagctacttaggaggctgaggcaggaggatcacttaagctcaggagctcaaggttacagggagctatgatggcaccactgcactccaacctgggtgacagagcgagacactgtatcaaaaaataaaaataaataaataaataaacaaacaaacaaacaaacctccttgaaattaagcccccactgcccagaaaagctctgtgtctttccacctccagtaacaccttccacattcctgggtccactatcttgccactgagtcatgaagacttctgagaaacacacaagggagagcagagaaaacatcacagtttaggattttagagccggggggcggaaagtgcttctgctggaatttctgtcttcctaggcagacaagcaaaggaaatgccggcttccacatggagaggaatacaagaacctgcaaactgctcttcctatcccactcacgaagctctccaaaccgttcttcctcccaatagcagtgacactcctggaacaaaaatccagtcacaccagtgcctgcactggcctccctttaatcctggaataaaatccaaattcgttgagatggcccaccaggcctacctgaagagcatctcaattctattcctccaaccttacctgcagctactttccacttgctgttccctggcctcactggtcttcctacagctctttgaacaagccacacgttctcccagcccagagcctttgcacgtgctatgccctccacctggagacctccccacttttcacatgaccaagagaaggaggtaccttctcttccaccaggtctcagtttacatatcgtctccccagagaatctgtcccaactaccgtatatcaagtccacagttgaagactatctgcattaagcacttggttggttttagtcccagtatttattgtaatttgcaaatatgtgtctgtgatatcttacctcccagtggtatatatgcttcatgaaggcaaagaatattgttcatctgagtcggtgtttgttccctgtgcctggtacatagcaagagctcaataaactcactgtatgaatgaataaacccactccacatttttatggataaaatgaatattcaccagtgtcatttgtggccagacattataaaatgttgtgtgtgtgtgtgttatatagtatttatatatactatatattataaaatatgtaatatttatataaaatatgtgatatttatatatatactttatatattatgtaaagataatatgtatctttacatttattataatgtaactctaaagatacatatatatgtatgtatgtatgtatgtatttatctacaatgatctaggcctcaccggttccattttgcaggtgaggaaactggagtgtgagaggttaaataaattgcccaaaggcacacagctaataaatgacagctgtttgacttgtgccaccaccaatcacagctctggatagtttatctctgttctggaactaaaggcatttaaatccggccactgaggaggatttaaccatgtctgccagggcgtctgctgtttctcccgggactaatctgccatgaagcagatgcaaagcttcatttatcacttccaacaaaacatggaagagacaaaaccccagcggatgctccctgcttccagtgtccaacagggcagggcttgtcccatcagggcctccaaggtgcctgtttccctgaggaagggcccctcctcccatgtcaccggggtcactgccccttgtgctggacccagggctctgtgctctgcatcagaccagctgagctgctctgtccactggggtgcttcgctcttaatgaggtaaaattcccataacatagaacaactattttaaagtgtacaattcagtggcatttggtacattcacaatgttgtgcaatcacacttctatctagttgcaagaccctttcatcaccgccagagaagacccccgacccattaagcagtcactccagttccccttccccagcccttagtaaccaataatctgccttctgtctctatggatctgccttgtctgcacatttccagaatcatatcatatacatggaatcatacaatacgcaaccttctgtgttgggcttctttcacttagaataatgttctagaggttcatccacaatatagctgggatcactatgtccttgcaagtttgggcccctggccagttagagatgtcgagtcagagagcagcacagagtacagagctgatagccagacttttctcaacctcctcagacccactaagaaatggggacatcggaatcattgcacctggaaattttctccttctgcaacaggtgggcaatccctggggggaacttgcccccaaacaatgaatcaccctgaggagtgccacagcagatggcagggcctgaatgtggaccagacccattgaggacaccagagtccagccctggccagtcctgggaggtccaatactcacaaagagaaaggaaaaaccttaatatttacatacctgggcacttttgctaaagaaaaccaaacccagaaatcccaagaactaaccaaccccaaaagtttaaattgtgctgtattttaagtacaacagattgtgatctgacctcactgtggcatcagcaaaagatgttacatacatgacagagggtcagaatgttatcagttccttagacaggggccctgagttgtcactataaatacaaccattagattatctggcaaaaaattcagtctcagcacaaaacacccattacttcctagtgggagtatcagcaacatgtaccatatatactggtataattcttgccctaaatcttcccttctttcttcactcaatgtcatggcaacttccatccaacacaaaaacagcaggatttacaacggggtttctcaacttcaatcaccgcactgttgacattttgagcaaggtatttgccctggggttgtcctgtgaattttagaatttttagcaacatccctggtctctacccactagatgccaggatcacccctcccacagttctgacagccaaaaatgtctccagacagtgccaaatgtcatctgagggtacaacatcaagaaccagccacttcgattcaggtcaaagagagcggctacagggagatttctgactgaggttgcatgagaagtgcaggtatgggattttgagccgtgcttccaaaattaggtgaattagaatcaactctgaattttccaggggccaattattcacatttccccaacccctgtgcccgtactacctgcattccacccaattcccagccactcacaggcagctggcatgatgggagagataaagaaatttggaatcaagaatgcaggcttacaggaaagttggattattttgttttgtttagactagagagacttgtgcttgttaaaatgcaccctccttgcatcttgcaaagtttcaatgctgcccaaccttcccccagcccctggcagcagagtcactgaagaaaagggaaggggtccccttcctctcatctctggatggcaggaattctctcctgttctccatagagcagggaaattctaatgcttcccctctccctccagaggccaatctccttcaggcaaatagacaaggagagaggtcttctctgggggaccagaccaaacaatatcgcaatgtttgagggcacagaagaacaaaatatacacaataagagaaagcctcactttcatattacagtaaataaactttaaaaatctcctcaatgtctctttcactcaagcccttgctccttttctttcctcccctgcacaccaaacttcttgcaagaattgtgctcattcactttgtccaccctcatacctttcactcactctccaatccagtgcatgaggccaccccaccccaggactcccggaaattgtcttgccaaggtcactgacgagtgtctctaccttgtcactgaatctaatgaccactccttcatccttatctaggatgtaaaatccatgagaacagggaattatgtctgtcttgtccacttttgtatccctagtactagaacagtgcctggcacacagtaggtgctcaatacatgcatttgttgaatgaatgaatgaatgaatgaatgagtgaaccccacttgacttctgcaaggtatttccaatgctgaccactctctccctcttcgtatccttcccttggtttctagaaagtgacatgccaatggttttcctcctacctccctgaggactccgtccatctcagcctctttatggtgtctgcttccatggctgatccatgagatgctcttcaaggccctgcaccaggaccccttctcttctcactcaacaacagccttttcccagactatctcatggcctcattaccacccagggagggcagtactgtttgagctgccctacaccttatcatcatttgtatctaggaacacccggttcatcctctggagaactaccccttcccactccagcctgccccaggtatgggcacatatctcagagttggcttctcagagcctcacctgcccctggcctgagtgaacagctcagggatggtcatgtggcccaatacaagccaatgtaagtgtggcccaggatttgaatggttggtgatgaaacttctctcttttccagtgagcttagagaaatagggatttggccatcttgcttccctaaggaaagagtgcatccaggagttcagccagctcacacaaaaaaaaatgcaaagtgaagagataagacagagagagagtgaaagatctgaaactgatgacctcatgtgagtccttaaattcagtgatgcttgaaggaccccaccctagaagtttccaagtaaatgacccaatacatttactttttgcttatgccattttgggttggagtctatcatggataaccaacaaccccagctagagcgatgactgccacatctgtatcaccaggcctgattcaactctgagcatcagacccacgtatccaattgtccatggacatttttatgacctctgccaaatggacaggctgctgggaacacgttccatgaacccaaatctggcttgattaaaagagctgctcaccatgtacacaaccaaccccccatgttgtcctcatcccactgttggatatcctgccaactacaaccctattacaaatgttgacttcctctctactatgatatcatcccattgctaaaaacagaaacttgggatgcttcaacggggaaacttatctccaagatgtctgccatcaattctttgcctccctggacatgcaagtcattctcagctaagggctgagctagggcctattcctactctccctttgcatctgctctggccttagttattttcttccccaatagaacgcagtagtagtgatgttctggaacttctgagcctaggtcataataaacttcacaacatctgctgccactgaagaagttggtctattctgaggtggccatgatggaaggaagcccaagctagccacaggaaaaagccatgtagagacagagtgcaatgtcaactaccctccagctattccagttttctcagccctggtgctagtcatgtgagtagagcaaccattcttggatattccagttctagcaaatgccacttgaagaagaagcaaggttccagttatatggattcatttgagctggccagccatttttgcctttgatccaccccagcgggagcatcaaacattatggagtggagacaaacttttccaatgtgcctgctccaattcatgacccacagaatcatgaacacattaaacagttgttggtttacattattaggttttgaagtaccttgttatgcagcaaagataactgaaccactcagctattttttatgtttgccaaaccattcctgaaatctacccaaaacaaaacactactttctaagctcaccctggccagaaaaaatctctattgtagaactgagacaaagttattgatttgcctgtctttctcccttaccataccttgtactactccagggcttggcacagtggctggtgctaagacatccagtatgtatccaacgaacaaatgaaaggaaggaagaaggcctgagtgccactgccctccatgaaaatgttctgtgagtcctagaactaaccgtgtctttgggactctgtggcagcaaagcggtactgcaagtgttattataataacagtgacagaatccaagcctagtaatcattaaccatccccaagagagctagttagctagcaaagaagaaagccccctcctcagggttgggagcactggtgccctgacggcacttggcttcaaactgaactccccacgccttctcacagagctgatctgtctataaaattggtggtttctatagaaacagaagcactgtagtaaagtgaagggaaatcgtacattctgtcagcgtacagagatcaatcctgttcttatatggggccaggactctttcacgctttatttttgagcatctcaactttcatttccatcccagccatctcatctcatatttatgaggctcctgcactggtaatcctgtcccttctcacctagctgcctttgttaactacgaccatgggcagaagtctgtggaaacagcatggaatccctggcatcccctcgtagtgccaatagctccaaaccccaacctgagaggcagaactgggatccctggtgttctggggtggtaaccaagatggtggacggagtcactacagaggaggcaccacagccttccacctagacattataaaaatctactctgtaattgggtacgtgttttacatgcctataccttagctttagacagtctccatgcccttaaatattaatatgtctgcaatctctgttttgcaccccaaagtgcaagtggctttctagcaggcaaggaaacagagtttggcttgtatttgaattgctcatgctgtctctgatcatctacagagaaaattagaaaaggcacaggttatattttagtattttagatgaaggtccaaattttgaggcacgtgttaactcatgaaaattgtctgcttcaatcaagattcactcttaaaataagaaataatgtgatgttttcttcatcaaagagcacttttatttctgacctaacagcactaaatgtattttgcctttttcctgttctaacaaatgactggttggatgaatagaaataaaatgatagatggatgagagaatgaaggatggatggagggatgcatggatgggtattaatcgtggatgtgtggatatatgatagatggatgggtaaacaggagatggatgaatacatgggtagatggatgggtgggtatatggatggatgcttggattcatggaggggtggatggatggatggagatgaattataaatgtgtgaatggatgatggatgagtagatgggggatgagtggatggatgggcagatgaatgggcagatggatagatggacagacaggagagggatagatgaataaatagatgggggggtgggtaagcgagtggatggatggatgatagagaaatcacccatcagcataatttttctaagatgtaaatctaatcatccatccatttattcatttacatttttgagcacctaccatgtaccaggcaagatgtgaaaagcactgaggattcagcactggatatctgagataaggtcccaatccttgaggacctaagatttcaatatctttaaagtagtaaatagattaaaggcaataagagtgggtgcagggagaggagtgcaacatctattaccatgatccaggtgagagctgatggtagcttggtctaggataacagcagtggatacacggaggcagaaatagattcaagagttatcagcaggccttgatagctgactgagttgcacagccctgagtctaaatctcagttcagccacttacacgctgtgtaagcctcaatttcctcagctgtagattgtggataattgtacctatctcccagagttgctatgaggaataaatgagatgaagtatgtgaaagagtcagacatagggcctggccaagaaaatgtttttaacaccaaaagcctccattttaggaaaaggcacccaaatccctgcttcttgaacccgggctatgagctgtgaggaatactaaatgctattagggttaaacagtagtcagaaggtcgagagagactcaaaggcatagcagggcaggatcatgtggccacgcagtgtccagcctacttcctcccctctcccaaggacgcaactagctgtgtgccacaagcctgctccacaccacatgagtccacacgtcatgccaccatggctagccattaaaaccacttcagaagcctgggcccatccatcgcagttggcgcaatcaccaaaattgaactttcatggagccagaatcaaagggctgcataaactaggattgtgtcctcctccatcagaatcatcttgcctctgcgtagctatgaaggacagtgagaacaaaaataagaataactaggcagaactctaagcaaaacagtgcaggaacaaaaagcagggacactggaacagctaggctgcctgctttaaacctcaattctgccacttactagctccattaccctaggcaatctgcacaacttctgcgtgcctcagtttccttatctgtcaaatgggaataagtaccttcttctaggcttatgataactaaggtgtgcaaatatgtaatgcagctggaacaccacctggaatacagtaagcagtatataagtgtttgctctaggtcgacttcatcactgccaagcactaatatgctccagttacctcactgagtacataaatgcactattccatttggtccacatgacaatcctgagaatgggttacaaagcagggggtctggaaatagatctaccagcatcttgctttatgggcagacacagaacctctctgaggctctctttttcccaccattaaaatgggtacaatagcactaacagcaggtacctaataaatgagacggtggattcttttgtatatactcttaaaaaaaatcttaggttggataaatagtccctttgtagacacagatctgaacgcagcaaagccattacctccactttcatgcccttcagctcatgccttaaatgggtttcttccccaccagcctttctctttttaacaacactctgtgccactgcagaatctgcaaagaaaactggaccaggccaacccaaaggaagttctgagggtggaggaaaggaaaccaaatctaaactaaatgacagctcccttgagtaggtatcctgagagtcagcagaggggcaaggctgcataaaggcggggagggtagacagagctgtgccttccaccactgccaaggtctcagctagcaggtgcatagtgaggcaggcctggccatccacagtgtgcagaagactgaggctcagagatgttaagaaatgtaccagaggtcacacagctcagtaagaggtagagctgggattcgaaagcagatctaactatctccaagtgcccctgccatggtacccactgccatccctcggtgaatcacacaagataaaagtataggtgagtctgtagttaagccataacttgttgttcacttgaagaagagctcagatgacctctgttcctggcgggggaagtatcttctcacttccacctgcagttaaccctgtagaatagagtctatcacactcctagaagagcctctggccccagcactcagaagagtcagccatctaaagctgcccagcccgtggagaagctgagccctcccgtttatgtaaaggcagcagaattccaccttgccaatttcttagtctctccagagaggacctcagatgactgagcctggctaaaccggggtttctcaatcttggtattattggcattttgcaccagattcttctctgtttagggggctgtccagtgctttgtagggtgcttagcagcatctctttcctctggatatcattagtacccctttcagtcgtgacaagcaaaaatatccccagaatggccatatatcccatgaagggaaaaatcacttgagattgagaatcactgccctggatggctatatcacagcctgggagataatggacgagtctgggagatgtcacagggggaggagggactctaagacctcccgtgggatggctgaccctggtatagtcacctgagctgagggtgggccctcgactctgcacaccgttagttcaatcctgccagagttgactggtctcagcgagactaactcagtagatccaactcataagaggttgatgtgtaacttgtattccaggctgttgatgtcccaggagaaacagaccttgcaagcagatcagattttcctgttatctaacctgtgccttcttctctagagggaactttggggaagcaaaatcatgataaggctcttgtttggtgagcaggactggagggaggaattgatggaagacttgggtgagtgctctggggccaaatctccctcccctggtccaggaggacagcatcccagcacctcttatcactttctgtctcctacagttaagccatgacctgacgatacatgcaacagtttgcctatcagacagctctgccagcctacaagttccagaaaggcaagcacagcatgttatccacatcttcagcagtaagtgctacatagaagatgctcagtcaacgtgcgtgtttgctttttttttaccatttgcagtcaccttcctaaaaaggaagggtgtgtggggaggggaggaagaaagggaagcaaaagagatttcctgttgcagaagaaaaatggcataaactctagagaggctaccatatctctaatttgacctgagctgagcaatatatccaggatttaaatgatgctggtcactcacttctttctaggtcacctttgtccaaggagacatccttagaatcacaatagtaggagaagacgatggaagaggagaggagagaagggaaaggaggagggaagggagggaaagaagaaaagggtagggaggagaggaagagggagaagggagaggagaaggttaaggaagggtagaaagggaaaagaaaggacaaagagggaagggccagggaggagagggaggaggagttacacagaagctcattccctatggacaacatgagtttaagaaacgccgcacactctatccccctcttagtgatgcacaacacacgttgccatagcaatataaatcatattaatgatcatcatcaacatttattgagcttttactgtgtaccagacactattctacaagcttatctgtattaacaccattaatccttcccacagccctgcgaggcacagatacattaaataacttggttactctaggttactggccagttagtaaagttgcacggctgaaaaacatggcaattcacagaccccacaaggtcctgcattaaaagcctacaatcccagaatttcccacacttgctttttatgtttgttgtcacaagcagcatcttttaacaggctgtggaacacattctggaaagcacagttcaaggacaatgtcggtttggttcaccctactaagtgcatgcctgaggcctcccaagaataagcctcaattgccatgactgaggggcataaccgtaattagtatgattattaacacttatttattataacatcctttcacttgtacttacattattgttccttaagctttacaatttcttcatgagtaaagtactgagattactgtcctcattttccagacgcaaaggctgaggctcacgaagactacctgactttgatccccagcccacaaaccacagtgcagcccaggaacagaggctgaggcagtacattctcacaaagacttcactgcaggggcaaagccaaggcagaaaaagtgagggagaaggagggagggagggagtgagggagaaggagggagggagggagaaggagggagggagggagggagggaggatgaacctatacaaggcagtgcatccccgggccagccacagctttgccagtaaacatcaccgcttgcttgggcacacggcagtgtggaagcccttggccttagcgcattcccttccaggagaggaagggagaggatttatctgctgccttggttcctggccctctggttaaagctttcccccacacacaggtggttaactctattgcatgtacaggttgtgacactcaagctcctccatgcagtcgttggaaaagccagatcctaccccgtagtatggggtttttccaagcattgtctgcccaaacttggtgagacagtttggatgttatcccctctaaatctcatattgaactgtaatccccactgccggaggtgggacctagtgggaagcaattggatcatgggggtgggatcctcatgaatggttcagcacctccttttggtgctctcctcgcaatagtgattgagctctcacaagatccagttgtttgaaagtttgtggcacctcccccagtaactctctctcttgctcctactctagccgtgtgagacacctgctcctactctagccgtgtgagacacctgctccccctttgccttctgccttgattgtaagcttcctgaggcctccccagaagctaagcagatgccagcaccatgctttctggaagcctgcagaaccaggagccaattaaatctctctctttttttttttaaataaattacccagcctcaggtatttctttcagcaatgcaagaatggcctaacacactagagcaccaaagactctgcagctcccacctgggcagaaagggcagaggagactgtgacaaagtctcaccttctcccctaggggaaatgagacagtcagtgttgttaagagtacaggtgacagcaacaacggtcaggactatgcactggccaagaagtcaaggcttggggaacaggtgggccaagtgaatctaggaggcacataaactgagtccaagataccgtttctttgaatccaaaaatgagtgttccttcattcagtggcaaaaagcattcaactcaccaaccaccccagcgcccaagtcacctggatctaaaccacccattggaaatgcagatttctgggccacacccagaactaaaggagtggtttcattgggagattcaaccacggagtctgcatatttttaacaagctctccaagtgacttttgtggtcactaaattttagaaacacctaggacagcatcaaaagctgccctgagcatgccggaactccccagctcatttgatagggaaaaatcgaaacctagaagtgattaactacagatcaataaaacagaacaatgaatcatgccaaaggtcgagtggcagtacgcagcagtacacggcaagccaatctaattaggggccctcgtaaacgtcacctgctcataaacatttataaaaacagatttcctgcatatggaagggtgttaatttttcatatagctgtaggtaaagtaaatgtatttttaatctcatacattgatttaacactgtatttctttttgaaagactgggagactcagtctttgtttactgatttctatatcagagaaactgctggagagagacgccagagcatactttctctcctcaggaataagggaaatcttctgattcttccacattcagactctcccttggttctcagagcccaggctgacatcagatgctacctaacagagacaaatgacacagggtgaggcaaggcatggaagaggggtgtcagttctgcaagggagatgctgtcacttgtaaagattttcattaataaaccttctagtacctactgttgcactgcactgtacccatctctggaaattttttaacaaactcagatttaattttctttctcattaattaattttttattcatctcttccattagagcctaaaacctcccaattacacattattagctcagaggaaagttggtaattgagatggtcccaggattccaggagtgccctgtgcagaatgtctgctttaattagatttccattaattacttttttatcaattaatattgggtactttgggcccaatacttgtgatctccacatcatgcactcttaaatgacacctcatttattgcagtcagtcaagcaagggacccaaaaagagttcagcagagagagcggcagacaggctctgtgcctcacatgcaaatgacatagcatgcttgcttgcaggggtgagtttcatcccctaatgtgtacctcgagaggctaggcaggttaggaaggagagatagagagagggagaggtggggtgggggacagaaggtgggggacagggagagagggagacagggagagggagaaagggaggaagggagagagtgaggaagggtgagaggagaggagggaaggggagaggaggggagggaaggggaggggagggagcaagggaggagggaggggagaggaggggctgggaagggaggggaggggaagaagaaagcaagggaggaaagggaatggtgggaaagggaagaagggaggaaaggaggaagggaggaagggtgaggaggaaaggaggggggagggggaggggagaagggaagaaaaggaaggaagaaaggaaacctacagaaaaacatcaaaagtgtctagtccaatcaaatcatttgcagatagataaatgatggccaggaagccaagtgacctcaccaaccctacacaacattaggctagaacatttttctcccctccacattgtcccctgcacctccctctacccctttactaggggaacacataatttatcatctacactaggacacttttaagagagaaaaggactgctgttaataattatactggggaacaatagacacaaaccccagcacaccaagatgtattgtcacccaacccttcacccctcggctgttaacttatgaacctcctcctgagagagacccactttttcaaggtggcaactctgcctctgcagccttaatatagctcagtatttgcctggaaaatcaatatgcattgattaatgacaataatatgatgcaacctccaccctctgaattcgcttagtattcccactgtctgtcttaaattaaatgtttcagttcacccagtatcttttcccaactcatttctcaactattcttttatagaatgtaacttaattgtactcaataccctaacctaattagattggcctaatggttaaaagtaacccaaaactggactacttgggtttgaacttagtggggtgtctttggacaggttaagttttctatgtgagctttcttatctgtaaaatagtacctacctcatagggttcttatgacgattacatgagctcatgtacgtcaagtgcttagaatactacctggttcatagaaagtgccatgtaagtacttgctaaattaaataaaaataaaaagttagagaaacggtgatcaccaaaagacataactaatttctcgccctaaactaagcggaatatctcaaagtcaaggagaagaaaagaaaaccagatgtgactgaacatagcttcctgtgccagggactgagacccgtacttcggatgcatcatctcatttaattcacagaaaagcccttgaaagtaggtattgctattatccccattttatagatgagaaaacagagattcagagagatgctgtgactggcctccaccatacaataaagccaaatcccctcaaaatccagcacaggtgggacaactggaaaaaaaataaaacaaaagcccagggtttcaggctgactttcaccttctgcttgaatcctccttgtttctagcttccactagcgcctaccccaagggagctctgctcccttctttaaggtcagaacccatgcacaagccattccttggttctgtgaacagctgacactggctgcaacttgcagaaagatttcctaagtccttaggggggagtccaagagagaacaaggacaggagacacagaaatagcccagccgacaatggacagtgccttatcttctggaggggactcactccttaccagggacctcgcaagctcatctcatcccatgctcaggttcctagaacaacatcactctcacctccaagggctggcccccttttcagacaccttgtccctcccatcatctactcacggagtgtctgggtccttatgtgacaatgagcaagtctggactctgaccacccaacctatttactagctactaggaactccctcatatacagtcaccaactagatcatatgtcaattttaataaatattttcactgatttattagtccatttctgctgatacaacaaaataccttagactgggtaatttatcaattgtagacgtttatttttcacagttctgaaggctgagaagtccaagatcaaggtgctggcaggtttggtgtctggtgagagcctgttctctgcttccaagatggcaccttcttgctgtgtcctcacagggtggaaggggagctggaggacctaacaagctccctctagcccttttataaaagcattaatcccattcatgaagacggagccctcatgacctaagaacctcctaaaggccccatctcttaatattgttgcattggggattaagtttcaacatgaattttcaagggatacaaacattagaccttagtaatagcaaaatatctcatgtagtcgcattaatagaagtaccttctctctgggtatgtgtagtcgccagcctgcatctgtcactgtttcctctccccccagtattgggatcacactaggtacatgcacacaggtacacacacatatacacacacagcccttaagcaactgggttgctaaacaaccagcaggtaatacaagcagcagctgccagagtgatacaacgatgtcataaacagcaccagagcagagagtaagaagcaccctaaatgattcatttccctatgttgggagaatatacccagacaggtatagctgttcccatttgtaaatcactaagaatgaaaaactataaccaatatggggcctaggaagatattttgtaaattaaataagaatgaagtatgcagaaaatgtatatttttctaagatgatttattgtatgaaacgccattaaatttcagactatctgttttgtgttcataaattcaagaaaacctggtttccatgaaaaacaattctttttttaaaaaaatgagataaacagataaaaagagatctggttttaaaagctagaaaaaaaatgaaggtaggtaattaaaataaagaaaagcctgtttgaaatccaattgttgataagaagattttaatgctgtaaggagcacagaactgtggaatacagaagcagcactgtgtacaactttccataaatgaagaagaaaagaaggtggtgataaagattgctatggtgcctgttggtgctccaaaaacataaaaccttcttttatccctcattccaagcagacctccatattgtgatacccttactcagagatgttggatattttagttattatgcacaattgcgtgctggttcaataaggaaaataggaagtaagtccttaaaaagaaagattatagctacatttcactggaaggaagtagaatgagtgtcctcgaacagaggaaaaggttaacacaatgttattccacatcacagacgcttcacagaaatgagcaaagatgtggggtgtgcactcctttagggcaggggagaggaaaagaaaccaactcaactgccttctaaaggaagagcatgtgggagggggcccccacactctccagggaggggtactgtggtcagttgaatgatgggcccctaaaaataagtgtccacattctaatccccagaacctgtgtatatgctacctcacacagcaaaagggactctgcagatgtaatgaagctaaggatcttgagtgatgagaggaggctggattatccagtgaggcccaatgtaatcacaaacgtccttataagtgaaggagcggggcgggagggtcagagaaggaggcgtactgatggaagcagagactggaatgacgcaaggccatgagcccaggaatgcaggtggcctctagaagctgaaaaaggcaaggaaacagattctcccctacagcctccagaaggaatgcagtcctgctgtcaccctgctgagtttagacttctgacctccagagctgtaagagaacagatctgtgtcggtttaagccactaaatttgtgttaacttgttacagcagcagtaggaaactaatacaggtaatgtatccaaaagaagagtagagaatgcaaaattaactctcagctcctacaccttctgcctagtttatagggttgatatcttcctatcattagttgaggcattaatgttgaacaacataataaatgcagaatttccatagagagttcaaagagcactgaaactttagcatactgggtaagcctgttgttacaggtaccagtgcagacagaaagctcccaataataaaatgaccaggagtaaattagaaatatgaaagacaaaagagatatgttatagggatgaaaagaatacctaaattacaaaaaaaaaacctttagaacagatttaaaaataagctacactgaatgtcctaaacatcctgaataacatttttccaagcatacaaaaagaaaaaacaagacatttacatggataaacatttatataagtaaatgactgatctcagatttctttacaatactgggctgaaaacgctaatgattaaatatctgcaggatttaaagcactctgttcatttatggaagaagcagaaaagtatttacaaatgtaaaaggactcagaaaggatgtacagaaacactaccaccaccatttacctcctccctctgccaaatactaaaagaaatgcctaaccaggccaggcgcggtggctcacgcctgtactcccaacactttgggaggctaggtgggcggatcacttgaagtcaggagttcaagaccagcctggccaacatggtgaaacccagtctctactaaaaacagtacaagctgggcacggtggctcacacctgtaatcccagcactttgggaggctgaggcgggtggatcacgaggtcagaagatcgagaccatcctggctaacatggtgaaaccccgtctctattaaaaaatacaaaaaaattagccgggcatggtggcaggcacctgtagttccagctactcgggaggctgagcaggagaatggcgtgaacccgggaggtgaagcttgcagtgagcttagatcgcaccactgcgctccagcctgggtgacagagcaagactccgtctcaaaaaaaaataaaaataaaaataaaaacagtacaaaaattaaccagatgtggtagcaagcacctgtaattccagatactcgggagactgaggcaggataatcgcttgaacccaggaggcagtaagccgagatcgcaccactgcactccagcctgggcgacagacccagattctagatttggtctcaaaaaagaaataaataaatatataaaaataaaaataaaaaataaaaaaataaaaacaacctaaccaaatggggtcatttttaaaaaataaaaaatgagtagttacatttttaaaagttggtcgtgagtgcccaagcaaattaaatatgaaattttcttaaaaattgatgtatatacagttatagaaagaatataaatgctataaatagttctttgtaaaagatagagacataactttaaataataattattaaattagaaacacgaataaaaatcccatacttaccattaacaactgagaaaatgagtaaggcttatataagggtaggtcaaactatgctacccaccctaccctgcacaggggaaagccaataaaatactttgtattctgaagacaattaaaaataagttttaggaaaaattaaatttagatacatacttaaggcagctaaacgtatccaagagtaaaaccaaaagcagaatataatagaaaacctaatcacccaccacagaatcagcaagctctctaagggccaaacagcaaatagttcaggctttcgggctacatccagttattgctgctgcctgttctttgttttgttttgtaaccctttagaaatgtaaatccaccattcctaacctgtgtgctgtcaaaaacaggcagtaggttgccagcccctgcaacctactgcctgtagggagttagggaggaagtcaaatttaaaaacaagcataagaaatagaaagcattaagtgagataaaattcagacacaatatagttatcatattagtataaattgcctcaacttctctagcaaaagaaattgtctcacagactgagtcaaaaatcaagtgtatcgaaatattttccataagatgtgatcttaagcaattagattgccaagaggttaaattgaaagcatgggtggatttaataggaaaatgtcaatagaaaaaaaatgcagatgtaccaatatccatatcaaagtaaaattcaaagacaagtcattgaacaataccaaaaaagctattctacattgataaaaggtataattcacaaagaaatatatcaactatcatgaccttttctgtagcaggtagcaatgcattgagatatagaaaggaaactgttagaaacccagaaatcaacaaaatacagtaatagtttgagaatttaatacaactctctttaagtcctgacagatcaaaaaggaaaaatttaaataaggaagtcatgactaatataattagtaatattgatttaaagacatatatcaaacctctctccctacatggaattaattatttttcctgtgctttgagtattttttcggtgatgattaaaataacaataaggccacaaagaaccatcaccagataatttttaaatgtttttatgttgtattatctgaccatgaggctaaagtttgaacaaaacaaggatatttcagcattcataaatcaattaataggtttaatccaaagaggaacatattttaagttaaaaatcatatatcaatagatgccaaactgtatttgattagaatatccattcttgatttacattcttagtaaaatagttcaattattattttaaagtgattctctacctactaaatccaaggttatcaacagaaaaattattgtaatttataaacaagttcagtaagatacccagcataaaagtaaataagtaaactcactgctttttcatataaccccaccaacaaatttggaaagataacgccagggaagaagacatcctattccataaacacacacaaacccaaaatgctataaatactcatatataaacagaggtgtgattgcaaatgttcacaacaggtcctctgggaaagaaagcccggatttatagtatttgctgctctctgtggcttaaataatgccacgatgacctacttcaaaagaccaacatgttaccactgaaggcagatatacaataagatactattatacagtgtttccaacttacagatatacaatagacatgaataacctcaagagtgtagataataaaccgtagtaaaataattagggagtcatgagttttgaagataacctttgtttttacatatagtgtatatagttgtaggtttctataacttaagtttaagaatgcctgtgtttaacaaacacctcatggaaattctgaaaatttaatagctcttatgagcaggtaccaggctgattccagcatatcaccgtttaaaaaagtccccaataatcttaaccagaaagattcagtacttgcaaaaatattactgaacttaactgagagccataaaacttcaacaaatagaggcacacaaagctcacagatggaaaaacttaacatggcactgatgttgattttctttcaattcatctatacatttaagaaatcccaaacgatacccccatttaattttctttggggacagtggagaagggatcctgaaaaagcaatcctaaatttgatgcataaaaacaaacattcaaggaatagctaggaaaattctacaacaacagtaatattcaatgagcatttaatcttaaagacattacaaagctagaaggtgcagaaaagtgtgtcactaaacaccggagaagacagaagctatggtctcagtccagtggggtagaaaactacccagataggtcattctagttccacacggtaagaaccatgatggaatagccaagaggagttgggggaaatgagaagcttgggaataccagagaaaggaagtgacatctgaattgatttgccttttcgggtcgtttgaacctttcgtcaaattggcgtccagaaagcttgcacaatttaaaatcccacaccagtatatgaaactattttctaacatgcttgccaacactgggtattataccatttttattttatcttgcctagtagcttaccttaattagcatgcctgatgtttaacgaggctggtaatatttcataaacttatcggttatttctatgtctatttttgtagaaatccctctttcctctgtgttccctcagtccctcctgctctcttattatagatctcaatacactatgtcacacgagctgtcacagccgcttgcccatccatttcccccagagaccaaaagtcagaagcaggcctgtgtctgtttggtcgctgcatctgcaacagaaggtaccgcccaacttatagtagaaactctgagaacatacacccagtgaacaagacggtgggttttagaacatcttcacctgggtgtcaagagcaatcacatgtgaaccacatcaaaatggtgctgcttcccccgcaacagagttctgccaacattattaacggcagctgggcacaaacaaggaggaaaaacaaaaatagagcaaggctgtagttcattccattgtacgtgatcatcaggcagagaaaagttcgtaaaaatcaaggagaaatttcttcagaaaatacattttccttaagagattgtttcagtgtacctgcggaactgtcagagaaaattagattctccgcaaataacagtcacttgcatttctactttatttctaaagaattcctccactttaacttccatttgttgtgcttttacaacaacttctttaagagaggcatttggtctggtattatctactcatcagactttggaaaggcacctcgggaggtgatatgactctttagcagacgatgagtttattcaagtttgctgtgacatttgtgcaagagcccagcccttcctcttgtagctacttaaagacaccctgagaacaggaactgctccatccctttggtagctgcagtgggttgagtggtggcccccagaagataagtccatctcctaatctcttgaacgtgtgaatctgaccttatttggaaaacgggtcttagcagatgtaattaatttaaggtatttaatttaattatttaaggtattgagatgagatcatcctggtttaccaaggtgggccctaaatccagtaacgagtgtccttataaaaaacagaagaggaaaagacacagacacgtggaaaagaaggccagaccaggtggagatcaaggcagagagggcaatgatgcggccacaaagaacgctgacagccaccagaagttggaagagacaaggaactgattgtcccctagagcctccaaggaagtgcagccctgctgacaccttgatttcagactgtggaccccagaactgtgagagaacaaatttgtgttgttttaagccaccaaatggatggtaatttgttactacagccctacgaaccgaaaacagtgaccaaccccattcaccagccccctaatacctttgtggcatttgtattcccccacccccacatgctgcctccttccctcctaggctgttattcaaaccatcgcagcagcctcctcattgccctcgctgccttcagcctcgccctctccaagcccacccccgctaccagatgtcaggaagaaattccaaaactcaaaccaaaggctgatacgttcttgccctacacttcactcaatgctggcaacccaatgagggacatcaggataaaatcgagaatgcgcggtctgtgcttgtgaattcctaccacctggccccagctagcctcccatcccttatatctgccaagacaaattcccccaaatcccctctcccctggccagaagtgacctccacattcagccccgattatggaaggctgtcacaggctattccttttgctgggtaagcccttccccctttcaagtctatgttcaactgtcatatcctttttgaggacttcctttagctcttccctccacctctactgccacacttaacagagcggagttgtctcctctggcatcccattgtcgatagcccactcctgagttacagcaacaacggccacctgactccactcatctgttgacctgtccatttctccattagcctatgatctcctttagggcaagattcatccttatctgattcatctttgtatcccagatcttagccaggcaaacaacagggatccagtggagagagagatggataggtgggtaggtgaagacacagatgtacggttgaacacacaaactggcaaagttccaaatgaactaataagtggacacctcactgagagacttaaatgcagaagggtgccaggacataagaggaacggctgcgagttatgaaaatgggctccatggggcaaatcaaaagtccactgaaggcaaatgcatcataacaagactggcatttcctggagtttccgggctgatcaatcactttcatatgcatcattcatttactcctcacaatgacctggtgaggtaatgagttactattagctcaatgcacaaggaagctgaggcttgtggacatcagctgaagtctcacagccagcgaatggcaggccagggcaccagggcctaggtctgcctgcctcttccatccaccttctgtcatcacaagccttctgatctccagccctctgatctgccccagtgggaccctcctgcgtctctgctctagttgtagaggacccatcaggcacttagagagaaatgagtggtgttgtgaacattcgactgtgtccatgtggaatccacacacacagtttgcctgaaaatgactgataggatggaaactgacaagtcatcatccgcttcgggcaccagcgatgactggttaacatgaatattgtgttgatttccgctagatagaagaagatgtcacttgtcgttaatggggtgtcacacgtacacttgcctaaaggaaaatgctcttttggtgattgttctcaattttcacctcattttatagccataaaaaagaaaagattcagcagaaaggatgaatccacctaggggtaggatggaaaggcattcttctcatttatttccttctttctttaccagaacaaccaaaacccagtgaaaatgctggtgcaagtcagaagagggggacctgggttctaagagcagccaggtactctgggcttcagatcagagcctcagaatccagcagttatgcccacaaggtagccaaagtccagccagtaccaccggtctctcggccagctatacttgcctctgctcaacaatgatgatttgaacgtacatgtacaaataataacagataacattactgagcactttactatgaactatggaatgtgctaggtaaagacgttactccacgtaagccataaaatcaacctatggggcaggtgcagatccacaaaccctgatttaagaattctgaatcctcaaaagctttgaaaaccaaaacattttttcgtaagtttggtacagacttatttggtgctaagatttgagttaaagtgatatacattgactaatagttttttctatctccttcttactattaatattcatactttttgctacaaaaatatcaacatgcttgatttaagggtgctaccacagcctctgctgagggatgttattaataaatatggtacatttactatattgctttcctttaaaagttaaataaatctaaatccgagcacatttggccccaaggactgcagacaagaaattgagaacctgttaaacccattatatggatgaggaaacaggctcagaaaaggtaggaaactttcctgaggttacagagctcaaaagcagcagatgaaggtttacatctaggcagccttgctccagagctggcccggttaatcagtgggctttgctacctttgacaaatgcccctgctagctggtctcagccccatcctcccagcgcagcagttcagtccctgtttgttcttgagcaagaagtaagcatgtgccttcttagtcgaggtacaaggcaatccccagggtatccggatcataattacaatgctttattaatataaatctcaggatatagacctgtgtttcaaatcaagagtcaaacacaacaataacatcagtcttaggtaactaccagtcaaggattcggatccagacttgcgcttttacaatgagaagcaaacaaagacgactattaattggctgatggtcagccagtatcaaattatcacattttctcacactacagtggttatacagaccctggagctagacaggttgtgctgaaatcctgggtcagccacttaatagttatgcgaccttgacaagttgcataacctctctgtgcctcagttcccttatatagaacatgggggtaatgctagcacccccctcaccagtcgtcatgaggattaaatgagattgtatttaaagcatttggaatatagcaagtccaatcttagcctctgctcccagacagacagatgattaggatggataaatagatgctttgcttcacattttaacttctctgaaattggggctcttcttaccattgatgtgtacttataatgtttatattgttattctcagaaagctgcagcttaactaatggtgcttctttttctttattgcatcttagatacgtggtaatatggtaaaatactttggaggaactggatgtatttttcctctggtctccagagaagaaactgagacgacagcaagtcacagattcaagctgtgttcataatgtgtttccacgtggaggtcacactttcatgttcatgggcagatgaattctaacaccaaacaccaggctgaataggtgttcccattgcaagagaagtgctgtgcacaatttttatttgcatttcaaaaccctaacaaatggccacaatcaactactacaaatttctcctaattagttttagtctgcacttctgtcacctttaggagagagccaaagattttaaccttcaaaattatcagcaatgcatgtcagaaagcatttcaaagaagagtcaaagtgcatgtagaaactaattgctgtatctgaaagtgctgtttgaagaatttttcagtcttcagagaagcaagttccccaccccttgggaaaactagtcttcaaactaaaagtttccccaaatcatatacctgagaaaaatgttaaaacagacttacccaaaaaggcaaagaaataaaactgtaagaataaataaatcagaaatcagatgtctctcccctgtttaaaatcctccaacagcttcctactttacttggaataaaacgcaattcctttaccatcaccttccaggcctcatgtggtctgtcccccacccatttcttccatttttttttcattctgtgttccccttcacaaactgctccaaacataccagtctttgttgttgtttgcttcaaacacatcaagtatattctcgcttcaactactttgctcttggtattcctccttcctagaaagattccctaaatattccccaactcccctacccacggataccaggctccgttgcacaggatcgccaacacacaaggtgacttagacccgaggtaactttttctgattcacacaaaagaaccatatgggctagagcagtcctgcttacctacaatgattcattcatttctagaacaaatgttaattgagcacctactatgaggtaagcactgttctgggcactggaattatagccttgaacagacagacaaggcctttgccttttggaagctcacatactagtaggctgaggcacacaatggatgacaatttaacaataagcgaataagcaaaatatcagaaagtagccagagtgcacagacaacctgacgtggttatatgacagtgactgaatggtaggtagtcaaagaaggcctcctagaggtggtgatacttgtcgtgaaatctaaatggcaacaaggaatcatcatggaatgccatgcctcccctccccaaccccatttgtttgtttggggaggggaggcacggcattccatgcagaggaaacccaaggtgtgaactttcacaaaggccccaagtagtgcacaatcaatttgttttagaaacaagaagttggaaagtaatggctagagaagagaaagtcaaagataaggccagacaggtgggaaggagccaggtgatgtggggctctacaagtcagaataaagaatttgaagctgggtgtggtggctcatgcctgtaatgccaacacttagggaggccgaggtgagcagataacttgaggtaaggagttcgagacctgcctggccaacatgatgaaaccccgtctctaccaaaaatacaaaaattagctgcttgtgatggtgcacacctgtagatcccagctactcaggaggctgaggcatgagaatcacttgaacccagcaggcggaggttgcagtgagttgagatcacggatcgtgtccctgcactccagcctgggcaacagaatgagactccgtctcaaaaagcaaaaaaaaaaaaaaaaaaaaaaggaagaagaagaatttgagctttattctaaagtgagctatgaaaatatttgaggttttaagcagggaggtccatgagctggcgtctattttggaaagatcactctaactcagggttgtcaaaaataactttctgcaatgaagtcctatatccacattgtcaggtgcagtagccactagccatgtgtggctactgagtacctaaaatttgactggtgtgacccagaaactggatatttaattttattctattttaattaattttcatttaaatattcacatgtggctggtggctactctattgatcagcacacctgaacagctgcatgaagaatacatgaagggtgtggggaaagatgagagtacaagcaggaagattaatcaggaggctaccacagtggtccaggggagagatggtagctgcaagcagagatggagagaagaatacctttcagggtggagccaagagtgtgagagggagaaaggaagaatgaggaatcgtggataccacctagatttgtggtttcagaaccaaatggatggtggtgccattttgatctgggaaagactgaggaagtagtacgttttggggaggaaaaaaaaccttgaaaataaccagctcctccccaagtcttcatgtggcagcttccctcttaacttttggacctaaaatgtcagctcaaatgtcacctccccagaggaactgttgcaatctccaccccacttctttatcccatcctctctctctctctgtgtgtgtttgtgtgtgtgtgtgtgcatcatattgctccattgttctcctccctgtagattatctgcaattatttaatcacgaatgcattgcctctctcttctccaaactgtaaactctctgtgcagcgacctcagccccttttcccacagtggtcccacctacctggaacagtatctggcacatagcaggtacttaaatatgaattattaaacaaacaggaataattatcttgccaaacaaaacacggctaaagcctcaaagagtatgtttctggtttgaatttcagacaacataaaatagaagaagacaaagtatgctcacacacctgctcaaataattgttgggatataactgggaaataattaattgggatacattttgtttggggttattttaccagtactccatttattcagaaaactgagtatagtttccaggtaatgagccacctcatctgacagatgcagaagagagatgctaatcaggacggtgattcctagcactacagtcccatttctctcccagagtatttggggagacagctgagagtgtgtagaatgaaagcagggtaatcccaggctgccatttttgaaagttcagagtgtccttaagagccacttgcccttagttaagcacaccaccatcacccacccatatcccgccaaccagcagcagatgctaccccagctgaacaggtgtacgtggctcaatgcaatgagaagggactttgcaattaaacagataataatttgaattcagttttaaggtcttgagaaaattgcatagcttctctgatcaccattccccatctgaactccccaacaaccaaaacctctagatattttcttgccaactacagctaagccacatcacccccaaatttttaagccccagagtacatctttgcatttacttgcttcagcaagttaagcaggagtttcactcaactttgtcattatttttcccactctcctctccaacttcattctctctgtaaacgcatcatacctcagtgcacgcgcgcacacacacacacacacataatcatacaattccacacccacagacacacacagagcttctctgcagcttctttcactctacactgactcacagtcgtgagaacacatttccttttcctcttcacaggctcctgaaatgagatcatatctgctaaaagcaatcgcaagtgctgggtgaacaactccagaaaattagtacaagttccactacggctagagacagagaagaggaaaaatctgttcaattttgactgtattcgcattacccacaaaaggaaacatacttcttatttcttccacttatcccaatccttaacaaaaattaaaacaaaagctataagctatttccagcactacccccaatggtcatttttaatttgtcatcagcattcgttccaaatcagaaatgtaccagtcacttcactttttgagtatgatttctcatcagtgctgctgcatcatctctatttccaaggaagctaaagacaacataacgttttaaaaaataactagaatgcattatagatttaaccatgagtcatcacagacattgaataaaagtataactctgcctccgtgagcctgacatatagacattctgaacaaggaaataatctgtggaatatctgatatagacacaaaggacaagagattaaaaaaaatcagatgtgaaaaaaatgttgttttccattgctttgaaaataattgaaatgaaaaactatctaatatccactcaatggaatatcatgcagccactcaaagctatttttacaaagagtttttaataacatgagagaagtgcatatgctatggttacatggaaaaaaaggcaagacacatgataatatttacagcatgatttcaattatatgaaaatgcaccaacaaccctaaaaggaaacacaaaaaaataccaccgatgattatctttgggtagtcaaaaaaatgtatggattcttatttttgtaatccattttcctatattttccagactttatggataggtacttttttatataaaaacctttcatttggcaaatttttattttaaaaaatcatctaaactttgtaaacttcttttattttgtgaaaatattttctgcaaaagcttctgtcttaaactgccttcatagtattgtgacgatgcttgaggaaacaagacagaattctcactacgcctatacccactaccaatttccaagcgggggcagctaaggttccagccaacactacttttctggaggctatagatgggtgggaaatctggcagtctagccgttacgtagaaatcccaaggcaatcagcaaagaaggctaaaacattaaaaccaccatggcacacgtatgcctatgtaacaaacctgcatgttctgcacatgtatgccccgttttggggaagaaataaaaattaaattaaaaattaaaaaaaactatcagtccaacttacccccccaccaaaaaaaaaaaagagagaacatcttagatagggtcatgaagcactcgatcttctcacatgcattctctcctcctttacacatgaaatccctgcaaggccagcgttatcatgcccatttgacagataagaaaatgaatgtatacagagaggaggaaccttgctcaaggtcacaaatcagtctcctgtcaacatctggaagcaaatccatgtctgtgatgctaatgatcaggatctttgcattataccatatggcagctttcatctggactacaataattgagaaaactgtatcagatacagggagccctgcatatcatcatcatcaggaaagacctgcactgggcctcctgccaaaggatacctaactgtataagtttaatgaatacaggcaaccaaattcccaccttatcccttaaaatcctagaaagaacacagagttgaaattaattgtatttaaagtatagtatgcattttttatttatttttttttttttattgagacagagtctcgctctgtcgcccaggctcaagtgcagtggtgcaatctcggcttagtgcaacctccgcctcctgggttcaagcaattcttccacctcagcctcccaagtagctgggattataggcacccaccaccacacctggctgatttttttcatttttagcagagacaggatttccccatgttggccaggctagtctcaaactcctgacctcaagtgatctgcctgccttggcctccccaagtgctgggattacaggcgtgagccaccacactcaggctgtttattattatggaatactatatcctaaacatgggattactacatcaaaatacaggaagatgcttaaaggctcttgatatttcttttcaaattttcctaataaaagtttatgtgagtttatatgtccataaacatggtatacaaataaccatttagttacatctttgccacctctgggaactgcaattttagaaaactgtcaaactgacaaaacaaagagggaagaaatggaagacttcctatgtcagcttttgaagaggtcatgtatgacataatctgaatatcccattcaaatttttaaccacagcactgccgaagccagccagccagcctgacttagccctcttatgggaaaatgtagcaagtggttctgtggttaaaacaagcacagactcataggagaattcaaaaaccaatgaagaccctgggttccaaatccaaaatgccagacagatgaaaggagagaatggaggatctagcattatatttactgatggtctatttggtaccacattctttcctatgttctaaattagcccttagaataatcttgtgaagacctacatttgctcccattttatagacaaaaagagtcaagattcaaaaacgtcaacaagggcacccagctagtaaatgcaaagctcaaatttaaactcagactcttccacccaaaactttttgattctttacccttatgttttggttttaatattttattttcatatcacttattacactttccaattttaaaagaaatacttgtttattataataaatatgtaaagtagtttggaagattctctaaagaaaaaaatcaagaattgttcataatctaccacccagagacaagaactgttaatactttgtttcattttcttccatttatttatgtttacatataatttaaataaaatcagtactagattgtatataaaggctagtttgctaatttttaaactaaatagagtgtgacttttgacagggcatttagtattacttgtaattatcattttttacatctgcagataattatatcaaatgaaagccacataattattttagctactctctattgctgaacatttaaaattgttttcctcagttttctatctcaatcttgtgataaaatccttttatattaccttttatgtgcatctctaattgtttccctaaactaataaattcgtgggaatggaattataatagtcctcccttatccacaggaactatgttccaagatctccagtggatgcctggtgcattggatagtacccaaccttatacatactacattttgtcctaaacaagatctccagtggatgcctggtgcattggatagtacccaaccttatacatactacgttttgtcctaaacaagatctccagtggatgcctggtgcattggatagtacccaaccttatacatactacgttttgtcctgaacatacatattaatatctatgttaaagtttaacttataaattagacacagtaagagattaataactaataataaagtagaataattataatgatattctgtaatcaaagtatgtgaatgtgatctttctctttatctctctttctcaaagtatcttattgttctgtacccacctattttcagaccacaggtgaattcgggtaactgaaaccacagaaagcaaaactgagaaaagtgagagaatacagggtcaaagagtatgcacattttaaggttctaaaactatatactaaactgctctccagaaagattgcaagaatttatatcctctagatgaacatatcactttatcaccaccaatactgtcagaggcatttgatccagagcaactccatcttgagcagtggctgggtaaaatgaggctgagacctactggcctgcattcccagacggttaaggcagtctaagttacaggatgagataggaggtcggcacaagatacaggtcataaagaccatcctgataaaacaggttgcagtaaagaagcccgctaaatcccaccaaaacaaagatggccacgagagtgacctctggtcatcctcactgctacactcccgccagcgccatgacagtttacgaatgccatggcaacgtcaggaagttaccctatatggtctaaaaggggaaggcattaataatctatcccttgttcagcatatcatcaagaaataaccataaaaacgagcaaccagcagcccttcggctgctctgtctatggagtagccgttcttttgttacctcagtttcctaacagacttgctttctctttactctaggaactcaccctgaattctttcttgcacgagatcaaagaaccctctcttggagtctggaccaggacccctttcctgaaataacactattgtttaaattgttgtcaacgtaaatcgagaaaaaatggtacctttattctttttaaatttatatttcagcaactaaaaggaaagctaattttttttcagatttttattgactatggcaatttttcttacatgagttgtaagaaaaacaactcatttttctgtcaagacacctttttgttgcttattagtgttctttatatatcaaggatagttagccattgtgaatcatatttgctgtaaatatttccctcaagttgttctttaccttttttgtaattgtatttttacttacaaatgtttatgaattttacacaactaactccattatcctttctcatcatttgtttcttggtttttacacttggaaagcccttgctccccgtaaaatcaaatacacattcacctatatttttgtagactttgttctttctactgcacgctgtgctgattcttatttcagacgggtgaaatgtcaaacaactgaaatatccttaaggtttgaaaaaaaaaggagaagtaaatctatctgagaggacacattcactggcagataaattatggatgatcctgccccctttgtaatctcagggatgacaactccagtgtgcaccaaaaacccttagaaaaattctaaatccccttatcctaggtctccagtctgggccttatgggaaccctaaagctgtgattctccccagggagtataaaactttggtctaaaggtgaataactgtagagtcaggtaggttttgtcccaaaatctcaaatcacccaggtattcccagaacgtctatcctgtgtccagccccaaatctcagccagagaacccagggagcacacaggcatgcctggagggggtctttttgagattccagaagccggagagcatgcaagtatgccggccgggaagggggggtgggggggggtcttcctgagagaaagcaattaaaattcacatcacaaaaggaatgaggctttttttattctaaactgcaaaacgtggtgtggttaatcagagcaattataaatggtaacatcattattcaagcttctatttccaaacgaagtcatttaaatgaatacattttctgccttggagcagtagctgccagtgagcctttaaaaagaaaagaaaggagaaaaagaaaaaagagaaaaccggatgaagccgctggtgcaaaaccttggaaaatagggtagaaagaactcagcattgggaattgggagcctggggtacaaacatagatccaacacggtctcattctgtaaccttgggcaagacttcagttcccacctgtgcaacggggaaatagatgaacttgtattcgtgaccccttcttgctctgacattgtgaatctagattttaaccactaaaggtctaatttttctacatgctgcagctgcaattttatagaattcatcaatgtgttaaatacattctcttattcaaattcgaagacaaattcttcagaaactgcctaagctgtctctaaatggtgacagacttccccccaccctactgcagcctgtattgtgtgtggtcttgaaggaaggagcacgtgagtgttgaaatcagatggtcctgggggtcaaatctcagctctgaccaagaaagccttgacattccttccccttggtttgactaaagttttagacaggtttcttcctgataagctcctcacctcccttttgttagagcgtctactttagaaaacttgtaactacaaattctttctctgctcctttaaaaaaattctgctggtcatttactagttttacaacccaagtaatgtctttctcaaggacctgggaagcaaccatttgaaatgtgagcattgaaggagagagcgtccctatctcccagtctgcggaagagtgggagcccaacttcagtgtgcctttctccaactttttaacctctcctatcatgaagatatgagaaagtttacttttcctttagtaaacttaagtagcaaacacagatggcctgagaattccagctcttaagaattcctcgtccctttgtttcaggagagttaagtcctgtctcgacctgattacaatggtcttgaataatatcttccttgcctgattaaatttgtcaggtgcaatttttacttaggcagttccaactgtgtaaatgtacctccttcaacttccttgaacttcagggtccctatccatgaaaagcaaacaacagaaaaagtccttcttttaaggagtgaatggtatatttcagggaataaatcagaacatgcatgtaatcacctgcacagagaaggtgggagattgtttgcaatatctacttccctgtaaccacacccttgggttatcccttcccacactgactgtggccctggccacgtgagttgctttggccaataaggcatcaacaaacatgctgcaagcagaggcttgaagaagtacttgcgcattgggcttgccctcttgttgcacttggaagcctgagagcatcacagggatgaacctgacctagcctgctggatgggaacccacatggaggagaaccaaggtgctccagagggcagcctgctgaactccagagatgtgagcagggcacttgagacacatgagagaacccagcagaaactaaacaagctggccagagaagaataaccacctactggacacgcatgattgtacacaaaataaaacggctattgtataagccactaagttgtgagatcatttgttacacagcaaaaactgacactatcaggcactgcatttatgttcatttcctttttcccttttctaatggatggctttgggtgttggctaggaaggctgagcactagcaaaacagtcaccaacccaatcagaaatggcaatggtctctttatggggcgctcttttcagctccttccagctccagaggccacaactagaccgagggaagaagacataggtgggaagatcccaataagtccctaaactcatctgaaaagatatgtgggtttcctaacaaactcatatagcatcaccaatatgtgggtttcctgattttggctcaggcacccttgggaaagtttcacgcattcctggaagtactgaaagaccttcgttaggttgacgaagaggtgtcatccatgagtttctgcctacacttaccaccaaattttcaaacgtactcagcatcattatgctgccggcacggggctgggtggtggagagagagagagccatgactaagaagccatccatctgtcctcacagagctcactgtgcatgtgggaggtagaccttaatagagtaaacaaacaagtaacataattatatcatgtgataaagattatgcaagaaatacacacagagcttggcagagcgtgactgagcacgggaccatgaacacccactcagcaaggagggaagggaaggcctctctgaggaggtgagatgtgaaataagatctaagcgtataaaaaaagccaaccattaggaaaaagaaaaatctgccaaagagaactatgtgaaggccctgaggcagcaaggagcttctagaagtcagaaggtgaccagtgtagatggatcgaaaggggaggagcgatgggagatgaggccatggaggtgagcagggccagctccgtccactcggcttccccagccaaggacctggttgcctcccaggtccttgatgagcagcctccatccctctgctcctctcccacacccgccctcctgaggttcagctccagggtgccattgctgctcttatgacacggagagcagaggttgaggatctgatgactgcaggcacaattcctctgtgccaggcactgcgtgaactttctgcccaacttcttataatctatccaggtagatataatcactacctcccacataccttacgggcattagacgatcttcccaaggtcacacggccagccggggtcagcaagcagctgccagtgctgggatttgggcagcaacctgtctacacaggctcagactccaggctggctccggtggctcctttggtgttatagtcacttccccactgggtgctttgtctcttctgctcttgttatttcaagctctcccatcctttgtgtgcacatcctttgtgtgtctcttcagggagccccaaaagagacccttaaacatctcctcttacatttcactaggttaaatttaggccactttgtagcctgtcacagccatgctgagtgctaaaatgccctacaactccaaggttggaaataacaatgaaaatgagttgagaagggagacccagtgttggctgagtgatttttctctgccagtcacagagctaagcactctacatcctcctgctgtttaatcccttaatcaaccccaggaagctgagcaacttcccaaggtcacagagacaccaaggcagagccacagtgggagtccaggcaccaccagggtgttctgcctcccaagtgaagtccccctggatgccatatccactatcagagggacatctccaagctgggcacatgacaccagcacagaaggtgtcttgcaggtcctgggctcctcctgggatctggggatgcccacttcacactcctgagacaagtgtagtccacagggaggtgtggccagaggccctgcccacaacccactagaaatgagagatggtttcacacaccttggaggtactgcccagagcttccccttccacttccaccccactgtcgtgtttctttccagtttcctgccttacttctggcaacctaatgttttgtgtataggccttattccattttccctgtttaacataggttgtatttccctgggcacgctggccccatctccatctcccatgggtcccaatttgcccttctccaccaccaacacacattcttccaatcagacaactccactttggtctcagctccccagcctggagctgactggtcaggtctaccatgcccatttgagttttatctgcaggataccaccatgttcgctcacaatcacatgcatgcaaatatggacaggtacactcagctgcaccaaaacatacaagttaataggcatgcatttatccacatgtgcacaagcacacagctccccatatataagcaggtatgttcatatatgaatgcacatgtatgtacaaacatgagtgtatatgcaggctcacagacacatacatacatgcacccttcctcaattcacaaagaagtaactaatcaaatgccacaagtcattcacaagccacgagaagactggaattgacagaccatataaagagacagacagaaaaagtcctgaacatgccagttaaaaaggctctgctattgtctatcacacagaagcttgtaaaaagaccacattatttctgacacaaatacagctctccactttctgtagaaggattccaataaagataagagctttctcattattctaatgtggaacaaaaacaatctcccctttccaaatcagcacacagaagtaaagtctccttagttaactctgcagctccctaccccatgatgctcagctcactccaccatcatgcagcaaattttcttgagcacctactatgggctgtcatgcaagttttattatttagttctcacaataacttccaaggtaggaatcattgcttttatttttacagaaaagtaaataggctcagagaagttctttaacttaaccaagtcatataggtagtagaagaagagcctaggcttgtctgacaccaaagtccattctccttgtatgatgccagtcataagaacaaagagttcaagaaagactcaagacctaggaatcagcaacagttaaaggaatgaatgcatagcatgtggtaagcagagccagtaagtgctaacgacagaggctgaccaggtggcttaggaagttttaggtggcctaaagggtgaatgtactggtagaagacagtggggtaagacagcaggcaattcaggaagaaggaatgaggaataaccagacatgaagattgagtgaatatgacccaactgggagctacagcaggagggatcttgaaagaacggaatggaagttgcaatgggggtcaggactttgaagagcaggttcaagagcctggatgccattacttcaacatttttacgactcagcaactccatgccaggccctgtactagaaagtgggaataccgccgggtgtggtggctcacacctgtaatcccagcgctttgggaggccgaggtgggtggatcatgaggtcaggagttcgagaccagcctgaccaacatggtgaaaccccgtctctactaaaaatacaaaaattagctgggtctggtggctcgtgcctgtaatcccagctactcgggaggctgagacaggagaatcacttgaacccaggaggcagaggttgcaggagccaagatcacaccattgcactccagcctgggcaacagagtgagactccgttgctaaataaataaataaataaagtggggatacagtggccaacagaacagaacagaacccaacagaaccaagacccctgctcttgtagagcttactctcttgtgggggtaggggtgggaaacagatcaaaaacaatgcacttttttaaaaatacagactttttaaaattatatagaatgaaggtggtaaatactacagagaagaaaacctaaaagtagatcagaggtaaaggggaggggccataattgtaaatagaatggtcagactcagcctcactgagaagatgttcaaagtctagcggggggatgaggagtgcgccccccagagccaggggaaggttgatgcaggtatcaacagcagccaaggtgaaggtacgcctccctgttcaaggagcagcccagcagtgtggccagcaaggctggagccagatgaatgagggtaagagaagcagaacacaaggtctacatttatgaccgtgaaccacaggagcctcaaaaggcaagacaacagggacataaaattagtacaatggtgtagtgagtccaagttaccgcggatcatttcattcatctctatcgatcattcattccatgaacagagcagcaggaaaaaaaggatcttaatatgatattcaactaatccttgacattaatatgaagctctgacactatgccaacgaatatgtcattgtacacacactaccttcctaaggccacaggaaatgggagcggcctcaagccagattttcttctgtaccagaatcattttcaagagcgattaggtgggagggcacagaccctgaggtgttcccagcccctctgtgactcactgaggtgttcccagtgtctccaaagcaaaccagcttcctgcagcctccacctgtccattttaggacgaccagcgtttgatgaaaatagacctaagcattctggcatcttcctccacctggactcatcctgagtcacccactcccctctgcagcatcctgtggaatccaactccagcattccccttagtacagctcgagagacagtttctgaatggagctttgtctagccctaagggtcatatgaggtcagatgaggccagcaaacagaactagagattcctagctcatggacgatgatggtgactgtgacaaagaaagcgacagtagatagtcatccattcttccatgcgtcactcactgtgggaaggagtttacatggatttatctcatttgaggctcatgaaactcctacaaggtagatagtatttatatcctatctgcagatgaagaaactaaagcataaacagtaagcagcctccacacccgactgtgaagacaccgaaccacacccagccctagaaagagagctgtacagtgggggcttctgtgaacaccagaggctggggacagactctcctctgggagaggactaacccatccatcctttgcagttgctgtcttagaggccacatccctgcatcaggctagaccaggtagaaacaaacacacactgactcccgcttcagcggttccaatcctcatatggtactggggctgtaggaaggcacaagaggccacagaactcaggacagttggtgggcagccatcatctccacctagacccccacatccacccctccctgcctccctctgttgtttccacccatcctcgcccctgcaaccagcactgcctccctacaaactcctctgaggtgataccactgccctgccaggagcttctcccccagctgcccttgcactttctacactgccctagagggtgcctactggccacatgaggctacttgaatttaaattgactgacattaaataaaatgtcaaattcagttcctcagtcgcacgagccacatttcaagtgcacaatagccaccaatggttggtggctatggtggtcggcagtgcagatacagaatactgccctcaaggcagaaagtcctgtctgcagctctggcttagctgacaaaatcccaacccctcatggggcctgccagacctgcatggtctcaccttgcttgcttcccagcctcttctggtggacacttggtcatgctgtcacactccagccacccaccctgtcttcagttcctcaaacataccaaatgtcagccacctcagacactcaccccgcccacactccgcccacccctcccccacagtttcctcggctaaagcccccattctatcaggagtcactgcaaactttgcttcctccaagccatcatccctgacacccccacaccaaaattcacccatacagataaacaatagttgcagtaattatcataacctctcactgcctgtctctcctttcatggcacttatgaaacgtgtaacatcttaaggccacagtcacccgaaagcttgacgggagctggggatcctcctccatgctcacacatgtggctgctggctggaggtcacgtgggcctcttcacaggacagcttgccattgcttccctctgagcaagggatcccacagacaggccgagatggaagctgtagtagctcttattacaatcgaatcttggaagtgacaaatcaaagcttctgccaaagtccactgatcacacacatcagccctggaacaacatgggagggattctacaaggaggcaaggattttgtgccccatcttggagacgggccactgaaggctgtgtgtcctgtttatcactgtgtccccagagtgttgaaaatagaataagtgctctgtcaatgttaccaaaacaaagaatggcagccttctcatcagaggggcctcactttccttgtctacaaaacctaggagtcaggcgtgaaaatatttaatgttcttccccattcgaaaagtcctctggtccatgttgactatgcagtccgtgcttgtcttgcccttagttgaagtggtgacatttaagtgaacagctgtggatctgtgctccacgggtctgctctctcagggacagggtcatgggatgggggagatgtaccaggcttccctccctctgacttgggtctagtccaggcttcccatcccccatgtgctgcaagcagctcggtcatacaacacatggcaactgacaggttcatgacggccaatgaaattatatgcaccatacagcagggaaacacactcacacaggaccagcagagccactgactttttattagatgcttctcccaggcaataaaccaggagagacagtggctgcagggaaataggaacccctggtcagaacctgtgactgggtcagtcatttgcagcagagatgaacattgagtcttggcctcaggggtaaagagtcaaccggagggacatgctaggaatgagggcaaccattcgacgaggtgacagtgtgccttgtgacctgcaactgccaacacccatgagcatcacaatgatggaatagtaatagctaccttgcaagaagcacctgctacatctaagacacttcacatgctttatccctaatgcttgcatcatcttctagacactaagcccatgtttatcctttatcataaggtctcaggataacatcacacagcatatgacagagagtaagcactcaataaccattgtgtgaatgaattagtaaatgaatgggcaaatgccatcagattggcattattatgcccattttatggaatagaaaacttaggtttatctctttgctccaagttatgtgggtggtactgagtaaagggctgggtttgaactctcaactccctgattccaagtctgagacccttttcacattacaccaaatccttaaatattttgcacatgggtgcaagcacaattagtaaaattctaccaatttccatgggatagcacagttcttcatgaaaacacagagatcaggaaatatttgtgtgagcagtgagagatgacaaaatgtagcactgccgtggtttgggagaacccgggagtatcactttagcagttagccagtgtacaaggcataccttggcccatgtggctggtgcccttcctgggtcacagcaagtgagcactgggctttcccagtgaggctgacaaggactgcccaggtagaaccaggggaacaggaaatgtgtcaccctagaaacgagtattggtttattattatacaaaactccactggctcccacaaatcaactcaggtaccacaaggatgttccatcaatgttttcattcccaaacacttgattccatttccccagccactccctcctccctcccttgacagcagaagagtctacagactgctgtattttctgatttgctttcatgcttcatttaccttacttaagtatgatttcaactgggaaaattgatgattataagctggaattttgagatgtaaacttgaaatcactgagaatgtgaaaggcaatgagcacagaaaaacctccagtcacagaaggtcacaccacagtcacatccccttgggcttctcccaataacaccacagcccttgtggagatgttgaatgaagactgagcagcattcaccaatgagtaggatgcacataggtgctttgtttcttataggcttgtcattattgattattgtagaaacaaacaaaaaaatgtgcctaagtatcatgacacgcacaaaacatctatcatcttacgaagccgtcaccgtttcaaagagatattaaaaaacatatgcacttttaaaagacattttaaagtctatgggaaaagaaggcatgatggtgaacaacttagaacaggggtcagaaaactatggttggctgcttattctaaataaagttttattgggaaaaaatctattggaaaaatatttcctagctggctttctagagaaacggttgccaacctctgatttagatactgcattgaggatttgttcagcttttttttaatgttggtatttatgaagatgttaagttaataagtgactgataataaaatcatctggtgcatgggatttagggttgttttgtttcgaagggagaaaaaaatgtttttaatgtataaacttacacactaatgggcccacatcaagaatgggtaaaacttcagagagccatagtgtatatcaaggccaccatacaccctacgacctaggtttacctctgtatctctcactgacactctcaccaaaaaagtgtgttcaacacaatagtgaagatgatatgtcttggaaaaaataaagcaaaatggtcacctcaattatatttttaaacaaactcactgtaaaatgagaagtgactttgaaaatgtaggtactgtcatggtttcagaactctaagtcaaaatcttatttttctttatgaagggaataaaatggtgacacaaagaaaggtcaaaatctaaataagaactaattcattactcaccttaatgaaaaggggagtttgcagagttagataatttagcagatattgtttcataactgaaaacattcttatgtgaagtggacagtattgatcagaaagagtttttgttatacaaaaaggaaagaggtaaagatgacctggtaggaataaagggtattatattagaaaatttagggggtgaaaggaaagctttacaggtcatttcgaccttgtggagagaagcaaacccaggagagaaagcgggcggaactctgaaatggtttgcattcttttaactacaaaaatgagggaagctgaaaacagtaagaatttgaccaggctgagttaagggttgtagttacatttatcgtgtaaaaatgcaccctcaagggactggacctgaggctcctttcccatgctaatgaaataatcatagaggccagccacctccagtcttgttctgaagtctgaaaagtttttctgcaaggcactaggatagtaagtatttttgggtccacaatacatacattatctatcacaactgctcacctctgctgttgtggggcaaaagcagacacacataatacataaatgaatgaacatagctgtgctccaaaagaaaaaaaaaaagaaacgtatttatataaataagctatctgaaatactgtatgattccacttccatgagttacccaaaacaggcaaatccacagagacagaaagtagagtggtggtttccagggactggtggggggcagatggaaatgggaagttactgtttaatgaacacagctttttgggggatgatgaaaaagttctagaaatggataggaatgatggttgcacaacacctgaatctacttaatgccactcaattgtacacttaaaaatggtcaaaatggtaagttttatgttatgtctattttaccacaataaacaaattaaatatatattttaagataaacacataatataagcatatctgattccttgttgcaaatatttgtctcacccttggggtccaagtgataactgggtggaaagtcccacgggataaatttaaaaccaggttcaaacaatcccagcccataaaaatttcttaagactgctagcaggttaaacagtcttccaaatacagccaataaacttttcattctattaaatattttttgcctgttgagatgagaatagaaacaaaattcttggttttcagtttactcaaagtactatgtgtgacataatttctctagaaattatattgaaatatttaacattactatttaaataataaacaaaaatcagcaattaaaaaaataaaagactgcccaatttggtccccaagtcatagttcgctatcccctactgtagaatttggaggacacatccaagaggttttgtgtgctacatcaagaatgatgtcatgagagaaagaacttgaggtctggataaaaggattaaattgaacccggacattgaaaaaacccctctgctgattctagacaagttgttgtagttcatatatagtgtcaatgcacatccatgttgcctcacctatttaactcatcagtgcccatccctggaaaatggagaaaaggaggaaactcagtctattggtgctcagtctattgggccagtaagctggcccaggaagcaaggaacctagctgccctgcctagcctttcttcctgacagccaggagggtgaggagcagaaaaaggagttagcatctttatccagcaaccaagaccaaaaaactcttagtgttttaatggcatgtgtcaagatagctgagccaaaaaagaaatcggaggattggaagattagacttgactagggagactgtttcagttacctattgctgcataacaggtcactcccaaattagttgtttaaaatgatctcaatcatttatggtctccatggatcaggaatcactagctcagctgggcagttctggcttgatgtcactggcacaactgcaatcacatagagactgatgcagctaagggctggtgagcacctctctcactctcttcatgtagtctcaggcctctccatgtggtctttcatgtggactagttagggcttcctccaagtatggccacctttaatatgttacatggtgacacagaactccaaagatgagtgtctgaagaaagagaacaacagttgcatagccttttctctaacctagccttggaagccacacagcatcagttccactacattctatttatcaagtcagtcatgagtttcaaggggaagggacacaaactgaggcatgacgagcttccggaaaagcacacggaacagaaaatatgtatttggccttttaaaaatatacaacctgcctgtaatcccagcactttgggaggccgaggtgggtggatcacacggtcaagagactgagaccagcctggctaacatggtgaaaccctgtctctactaaaaatacaaaaaattagccgggcgtggtggcgggtgcatgtagtcctagctacttgggaggctgaggcaggagactggcgtgaacctgggaggcagagcttgcagtgagctgagatcatgccactgcactccaccctgggtgacacagcgagactctgtctcaaaaaaaaaaaaaagtatgtgtgtatatatatatatgtatgtgtgtgtatatatatacacatatatgtgtgtgtatatatatacacatatatgtgtgtgtatatatatacacatatatgtgtgtgtatatatatacacatatatgtgtgtgtatatatatacaatctgccataagaactaaaactcatttgggcctttcagtttatttacatatgaatacaattaaaatactcatgataaagaaaatattctcggtcctctttctttgctcacacactccttggaccagcatttcccagactggtaaaccaagacatatgacatgaacaacctgacttatcaccaaaactcaccaacattagcctaaaatattgcatcatgccacctttctggtaggattcagtacctctctgcttggtgattgccctgacatcgcttgtcacacagcgaaataaccaatttatgcgagtaagccctgttgagatatcctgactcaaatagaagagaaactgtctggacacaagcccaaaacacattgtcagctctccactcagtatagtcttctcagtgacagacttgagtcagtgcaatttcatccattaagtaacgggaatagtagaaaacttttgggatgttattctttggattataatttaaaatatgtgtggcaccggtatgtattcatctgctatgtatttatccactcccatttcattgatctctccctaggcacataagaccacctcatttctgagcttctcttgcagttctatcgagaccatgtgactggattccaatcaactgcatgacttgtaggccacttccaagccttaccataaactccactctaatgctccacactttttctcttcttccttccaggctgaactcagagaccaaatgtcaatatgacaagttagaaggaccccagagtcaccacttgtgaggtgccacaaaacctattttgaaatgtgacttgaattagaaatcacctttgtatgtatgtattaacccattaggactttttttttttcctgctccaaaggtgagtaccaaatgaaaaaatacaaaactcaggtgctactggaacctagaacaatacaattttttgttatacaggctgtctcataccttagagagccagatgccaggcacacatcccaaccaaaaagccactgaaatgttagagcttattggtattgcagtataaccaagactagtctgactaatataatgttataaccaatatgaatatattaatgagcagaattaaaaattcacataaatttttaagttaaaacataaaactttaaagaaatgtcctccttgaggcaggttcatctggctatgccccagactcctgggagcacatgcactttctcatctgctattaggaaaacttcaatggtgatgtctgagaaacatcctacagcatttggcagagacagcctctgaaaccagatgaaacccagttctgctacttcctaactcttgaaccactgagcctcagattatgtgatgggggaataaactgttattgtataatgtggttaccactggtgccagttggccaagaagaacagcagaatttgtcatagaaaagcaacagctctttgtttagggaaacatcctaatctgcttataaaaggtgaggcctaccaggacatgactaagatgaaaggacattggctgatgagaattccttgtcgtattggttatctactactgtgtaacaaattaccccaaatcttcccagcttaagttgacaacactttgtttagttttacatagtttctactattcagaagttcaggagcagcttatctgcgtgcttctagtgtagggtccctcatgaggttgtagacaacattaatgaataaatagttaaaagtagaaataaccccactgattctgttttaagtcagagggcatattgaaagcattctagcaaggggaagagcatcagagctgggggaactgggagaaccgagttctaatcccgtatttgtcttgcaaacttgtgtgaaccaagtgacacacccaatttaggcatccacttcagggctcaggtcatccttaaacccctcctacctctgaaacactgggctccttgggcccaatgtgccatcctgacattgtgagcatgagaagtgaggacaggcaagcacccctgtactgagcacaaaaatgtcaggcctttccgagtcttcccaggaaggactgtcttcttcttcccacactctcagaacacaggatcttaccatccaactcactacattttcccccagagaagaaatcccatgtctaaaagcaagagcctcttgttttctttctctttcttcatccttttttgaaaagtctgtttctattgtgacaccaatccaacccattccattgctacctcctttataattttttttaatagtcagcgtatcactctgttgcccaggctgaactgcagtggtcatagctcactgcagcctcgactcctgggctcaagcgatcctcctgcctcagtttcctaagtagctaggactacaggcatatgtcgcacatcactatacccagctaaatttttattattttttttgtttgtttagagacagagcctcactatgttgcccaggctggtattgccatctacttaacacagttccctctctgcatgtcatggtagaacacaggaaaggtgacaacctgattgccaggtgaaagaagagagttcccagcaccaagtgtgcttccaggcatattaggcagggagtgaggcaggaaaggaggaggaatgccagcacacatgtgagcaacttctatatgtctggctccttgcatgcacaattttaagatccttacagcaatcagctgaagtacccacatgttacaggcaaaaagcagtgaggctcactccaagcagttacattggccaataccctgcagcgactgcatatgagaagtgagatttgaatagcatatgtgaacccaaacatggggtaaagaagaaaagaaggaaggaggaagagaaagagggaagatgtatccgtgattgcttccttccagactggcacaaaaatgaaaagctagctctccttgatgggacatgttgatggtatgcaaggttggatccactttgcacacacaagctccttctgctatgaaagagatttaacaacctcaatgaatccttagggtgtatggagtggtgacggagattattagaaaaaaattcttatctacctttgatgtggaaggaaaggggggcccaaagtggtcattataaccaacttgaatcattacttgagaaccagcacagcatatcgtcaagtgtggagactccagaggctgagtttgaatctaagctttgacacatatcaatatgaccttgagcaagtctcataatagctatatgtctcagcgtcactatttgtaaaatgggaacaatagtatctactgagaaaacttgttagaaagattaaacaagtcaatagatttaaagtgctcaaaagagtagctggcatactcttctgtaatactcaataaatgcttgctataataattagtggtgaagaatgtgtactccaaagccagactgccaggattcaaattccactcaaccattccaagctcatgaccatggagaattgacatagcctttctaagcttccattttctcatctgtgaaaggagcgggaaaaaaatctatctcagaagagttttagcagatggtattttccaaagatgactacaacagtatctcccacccccatttgcttctacactgtgactttgccactgccccattaacacgggcaggctcattctcctcccccttgaacctggttgtgactgttaacctttccacaaataggatggacatagcagaagtaatgctgtataacttctgagggtacattagaaaaagccaggtagcctcttcctggttccattgagatgctcacttttaaaacacagcctccatactgtgaggaagcccaagcagttcaagaagaggcacacttgagagaaactgagccctccagctcatagctaagctgagctcccagcactcccttgatagtcagggaagtgagccattttccagccctcaaactgtcccagcagatactgcatgaaacagacacaagctcttccactaagccctgccgaaaatgaatatgcatgagcaaaataaatgattgttattgttctgagccactaagtttctaggtggtttgttatgtatcaatagtaactaggacagaaacgctggggaaatttctaaatgacaataaaataaggacttagcttagtgcctagaatgtgtgaagaagtgctcattagcgatgatcattgttggtatcgttcagtaactttccaaagtcacacagctaataaaggtcatgaccaggattcaatccgaggcctccagtctcacttcatattatgctgaggatcaggaaggtaggcaaatccaatgttcaaggaaccaagcacctcttcttccactgagctggaaggctggagtatcaagatgatgggaacatgggcaatgcctctttgtggctcctacactcaggtttggattgcaagcagagaccccagagactatggatgagggaacattggctaacattctttcttttcctttaagctaagtaccaagagtgtgagatcgttgattctcaagggaaaagctaccccctctatggaaaagtaaaatatgcaaacattaaccagaggatagatgggaatgcataattcacaactagctgtctctctggaccaaagcaggaaggagttggttgaacttcaggtcagagaaaaacaattctagctattgcattccagcacctacgtattcaattaccataaagttttttgcccctggggagaccactggaacctgcatcagcatcaaaacctttcttaatatgattctgcggtaagctgagatatgcagcaccctggcaattgatatgcaaattaaataaacaaaacgacataataaataattaaatcagtctaacttgatgaatgaattaatcatattggagtgatgagaagaagccggcactgtcacccagaagatcattgagaaaaatgaaacattcataacaaggccatttcagcataggatgttgcctcctatattgattacctgcactagcctttgaaaagaataggtgctcaataaatattagtggaatcaaaagaacttttatcaccaagatcatctctctgcagtatatggaattattcattcaataagcgattgcatcaacattttctcatttcagtcttatttaagaataaagtaactctgaaagggagacaagggcagatacttactgatatctcccatcttacagttgaggaaaataaagctaagaccgagtgacttgcccactgtcatatggttggaatgagaggaacttagactcaatttgggagtcctggcctctattaccctcctctgcaccccactgatggggatatttctgtctacataagtgtgtatgcagggagagatgctacagccacccactacttctccaaccatttcccgtaataaatcaattccagattaatttcaagtttatacctgaatacattttgtgcctccacccatttttgccttttgtttagttactgtacatagcatctctttataggcaactaagaaatggaggtaggcatgaggaaaagaaaagtactgtgcagccattaaaattaatggtgaagaatatttagccacataggaaaatttccgcaatatattgctaagcaaaaacaaaggctttcaaactgcacatatagtaatagacacacacatacacaaagagacaaaaagactgaaagcacacgtcaaaaagcaaacagtcattatttccacatggcgggattataaggggtttttatttctctctttgggtatttgtaaatacttttagaaatttatacaataagaatgtattaacttttgtaatttaaattgttatttgtaaaactaaagcaaattatagtggtgggggtggggaataaaatgcttctgaggggtgggaatggtggtcaggctcatgagtgtaatcctaacacattgggaggccaaggcacgtgggccactggaggccaggggttcgagaccagcctgggaaacatggtgagacccagtctctaaaaaaaaaacttgtggttttttttttgttgttgttgttgttgtggtggttgttgttgttgttttaatcagctgggcatgatggcgcatgcctgtagtcctagctacttaggaggctgaggccagaggatcacttgagcccaggaatttgtagctgcagtgagctttaattgagccacggcactccaatctgggcaacaaagtgaaaccctgactctaaataaataaaaatgactctgagcccacatctcatagaagtcatatatgtttcagtattttgttttaaagaggatttcttatcaatatggctaaattttgaggctgtgtgggatgcgaaataatttagaacttcatcccacaatgagatgggatatgccctcaagtcagtggctctgaaacaagatgaaataattacaaaaaagaaaaaggaaggaagggaggaagggaagaatggaggaagggaagaagggaaggagggagggagggagggagggagggagggagggagggaataaaaacctgccaaaggaaaactccctagttttcctggaaatacccaaccctttcttcttttcccaattccctaaagggctaaataactcaaaacagaatataaacttcagagatagcccttatttctggctctataggagattcgatggtgccaaggaaaacaagttatgtatcaaagaaaaatcaactagactatttcagaataagtaagagacctgaaaatatacacttccattccaaaacgagttaaagaaaaaaaaaggcagaagggagaatcatgcagcacatctggggtgaaaaaaaaagagaagtaaatagatttttaagtgaattataagtttgctgtgtgacagcaatgacttgaactctcaaagaaattgaaaaaaaccacagaaacaatatatcaaaatctaaaatatgaaattataagacaataaagtgacatgatagagctaggaaaaaagttaaatcataagttcactgcagaatgcaaaataacataatggagcaagtcaacaatgtaattataaaaaaatcaaaacttgagattatcaaatagaatgcagaagtacatgacagactcagaaaaagcaacccaggagacaatattggatgcaaaaaataaacaacaaggatctagaatgagcgggcccaagaaagaactgagaaagcaaaatagaaagtagtcagtgatacgacagaagaaaatattcataatcttaaagaaagtctaattgtgactattagcaggactcacaggcaacagaaaaaaattactgaaaagcaaccaatatggagaaacatcctagtgaaatctctgaataccaaggattaaaatagaactgcacaagcatgtcattcaaacacttggtcacctgcaaaggaaaatatcttttagcatctctagatttcaggaaatcatccatgaagatctgaggaagaaggtattattcttcacccagccaaccagttattcatataaagggtgaaaaaggaggaggagaaaagagaagatgatcgtgaagacattagaagggaagaaaaaagatgaaggaaaagaagagacaaagatgaagaacatattctcaaaatacaaggaatcatgaatgcactattgctgaactgaaagctaggagtcacattctaaccaaaagttcaatcaaaatatagatctcaaaaaatgagtaagcagtaatatgaaggcatcttaaatttttggtgaaactcaaaaatagaattgagtctaaataattatggcatagttatacaactttttaattgttaaactttattatttaaaaaattttttaacctacagctagaaataaaagtagattgtgggtattccctatagcaaaggtggatactcataacaacaacaaaaaaaaaacagatttaaaggtaaagatatcagttaaaactaaaagcagaatggggttaactcaacagtaagacattcttaaaatgaatccaaaaccaataaaaacaagtatacaacatttatcaggaagaagactaaagctgtaactcaaaaacagaaaataaagacaaaaatataccaggaaaaaaaaattctaagaaaatgaaagcagagattattcttttatacatgattaagctggattcaacaagagaaatagtattaagttttaccaagaaagatcactttcaaattgacaaatggcacaatccacaataaagatataagtgtcaaaatgcccatggtctggattacacagtatcaaacattgtaaaacaaacaaacaaacaaacaaacaaaaaaacaaacaaaaaaaaccaccattgaaaatactaggtggatgttgtggggctgatatggttgggctttgtgtccccacccaatgtcatcttgaattgcaatccccaggtgttgagggagagacctggtaggaagttattggattatgggggcggcttcccccacgcggttctcgtgatagtgagtctcacgagatctgatggttttaaaagtggccatttctcctgtgcatgcactttctccttcctgctgccttgtgaagaaggtgcctgctttctcttctgccatgattgtaagtttcccgaggcctccctagccatgctttctgttaagcctgtggaacagtgaagtcaattaaacctctttcctttattattacccactcataggtagtattttttatagcagtgtgaaaacgaactaatacaagggcagtgaaagaaaataacagcagtgactaatcagaaagataataagtattaacgtaggggatctgattaatattattaaaatcgatataaaagctttacgcatactttgtgtactgtaaatatttagttccttttctaacactcactaaatcattataaaatcaaccaaaattaaacaaccaagaaaacaccattaagttttcaaaaaagaaattaataatacagattacagtctccatttacactacaaaagccaaaaattaatttcaaaagtagaacaaaataattatttcaacagcttggaaataatttttgggtcaaaaataaaaccaaaatagcaattacagatttttagagaatagcaataatgaacccaatacatatcaaaatacatggaaagtagccaaagtataccaaatgtaactttcatagacttaaatactttaataactgagcaagaaataaaatgttaattatttaagaaatcagctcaagaccctagaaaataaagagttgaatgaagcagaaagagaggcttaataaagataaaggcagaaaacaattcattaaaaaaacagaaaaacatcagaataaataaatctaaaatctggttctttgagaaaaagaaaataaactattaatagataaaacatgaattaatctcatcaaagagaaaataaaataaaagcataaaccaaagtagaaatgagaaggaaacagttacagaaagaatttcaaagtttcattcagtagaaaatacttcatctgtcaacaaatttgagaacttgaataaaattataatatatatatctttcaaaagagcactggatccaatcattgtctagggtaattcttgtgtctttatttgcttaattttattgatttattttttgagacagggtctcactctgtcacctaggctagagtgcagtggtgcaatcatagctcactgcaggtctaccaactgggctcaagcaatcctcctgcatcaggctctcaagtagctgagaatacagatgcatgccaccacacttagctattttcttttattttttgtagagactaggggccggtgggagggtctccgtgtgttccccaggctggtctctaactcctgagctcaagctctcctccaacctcaacctcccaaagtgctcggattataggcttgagaaaccacgcccagcctcttgtgctattttaagtcccttagaaccttgctacacaaaatgtcggccctgagccagcaacatgggcatcacctgattagtcatttttacttatactttgtgatttaaaatcccttttgcaatacagatttttaaaaacttttaagaagtatctcgcattgtttttatggtttcctgatggttcaggttactgctagttagaaaggcagactctcaagccccactctggacctactgaatcaccatctgtattttaacaagctcccagatgattcataggcacatttgagaagcatggttttagatctaaagaggaaagcttccattctttaagaatagtatgtaagagatctacagattattttatttatacagactcaaaagtccaagttgaaatttctagcaaaaagaatccaacacttcattaaatagataccattcaacaaagaagtggatttcatttcaggaatgtgacaatagtttattgctaaatttattaagagaaaagaagaatataagtgaatttactttaaaattattttaggctggggaaggcttttttgagtacaaccccaagccaaaaatataaattcagtggttgaaatacttcataaaaacttttaaaaatctgtattgcaaaaaacgttttaaatcacaaccaagatgtaaaaaaaaaaaaaaaagactacaaatatatatgaagcttcaaagaggggattattatctacaatgtacaaagagctactaaaacttacaaataaaaagacaatggatgaaggatattaatcacttcacaaaagaaaagcaaatgatcaataactatgttcgtgtcttccctcattcaccagcaagcattaaatggcactcatctagattctgaggactcagcagcaaataaaacaaggtaacttcccacaagattatctaactaataattaaacaaaaatgtcaactaatagactggtacctgacagactggcaaaaattcaaaagataaattaatatcctgagtcaacaaatacgtcaggaaataaacaccttcatacattcatgatgggactttcaactgccaccaattgtgctgcagtttaataaaataaggcatagcttctaacagaatatatccatagaaaatagacaaataggtatgaagatcttcctcacagcattatgcacaatagtgaaaagaaccttcgtgtccatcaacagaagaatggcacaatagcatcaccaacatttttcatctattgctatttgttcatatattaggtatgtattatttgttatcatatcaatagcagaataaaatactcttgaaatatttatttcacattatttcagatccaaggctaagatatgttagaggcaatagaaaccctaatacattttacatgacgatgatgaaataacttgtgtgggaatttggctttgtatataagatacatatgtttagggatgtaagcatcactcaaagcttcctgaaagacagatccaaggctgcctatgtgtctctgatagctgaggctgaccgtctcagaaccacactcaaacacagtgtggtgttcagatgccttcatcatcatgttcctcctatagttcacatcccctcctttgcatctcaccagcacccaggaaccagggtgctttttaaaaaaacacacaagttaaatcccagctcttcctccattggtttcttactgctgtaaccacaaaaaggtaaggtcccgattctaatggcccacgaagtcctgagtgacagtcaccagctcctgcccactctccaaccgcatcttgttgcttctttcctgtgactcccggtgctctggccacatgagccttctaacaattcccagagtattccaagctctgtgtcacctcagggactttgcacgtattctcaaactgggtgttcttttccctgttctcttcagaacaggcttttctgtccttcaagtttcagcctaaagatgctctctgcagcctggctctactccctggccactacaacaccctgcttgtctccttcaatgcacttcccacaatctgggggaaacagaggagagaattggccatactttgtgcattaattatttttttacttattcactgtgtgtctccttcactgcaatgtatgtttcagaaagctgaccctgtgtctattttgctcttcaccgaatccccagcagtctagctcagagcctgcaatgctgacggcattcaaattctggtaaatgaataattgaatgtgaacacaatttggacagcagatcaaaaaccttatacaattttaaaagaaatatttgtgatcatcttttcctcaatcctcagaaaataatcacaagaagtacacaaagattaatatccaaagatgctcgttacaacattcttctaacagcaaaaaccagacacaacctacaagcccaacaagaggaaaatattttagttgatatataggatggaatagtcaattataaaatatatcataatgtggtaaatttttaaaggggagtaagaaacaatgtgtagttggaccctgaacttacaaaatcagcatacaattctatacgcaaaatagaggaagcatatattacaaaatgagtcatggtttgtcttctttcatatatttcctacgttttccacctcgacatatttttaaagttttgacattgagcaagaggatacatttttaaaacagaaatgcaaaataaacatcatttttaaaaattaataaaagaggtcactcctccccatgagtataacctttacatctcatgagaaagaaaacttttattttctaatatattttaaattgtgtgagatacttaaaattgtgtgagattctatcaacatgtgaagcatatgttaattcattctggttctcaaaacccaaggaaagaatcattcatatgggctttcaccccaaaatctacagaaaccctctacatcctccagttctcctgtatctgcctgcctctgtagtgtctgctctggtctctccatcagtgtctctctttgcttgtgtgtttcacgatcagcttccctttgaactcgacatccttgccacccctattctccccgggggctgtcttttctcctcagttggccatgatatgaaaatagatgagaagcatttattgaactgtctttgtttttctcccattaaaataaaaccagataagtgaaatcatctgtttacatttctctcaaaaagaactgcattaaattactattggtcctacaggtcaccgaccctccgctgctcagcagtgcccctcaccagaggcccccagaaagacatgtccttgctgagaagtctagcacttgggcacataagcagacactgatgataagctgattagaactgcgaggcagggtatagtgtggcaatgtagagtctgcacagaagtccctgagaccacacacagtaagtgtaaaacttctaagaggtcacaaaaacagtatcttgttctaattcgaggggacccaccttcatacatcagcatgaactgaacccaggtgaatcttgccagaacaatcacagaaattagaacaatctaaaatcaatataaagagaagtctagagagagacgatcagagctcatgagatcctgaagtcaatcaaaaggctaaacaggatttgaaacctcatcacttatgtagaaaataaagtacccagcagagcaaaagtgaaagctgtctcctaactatgcagctctctcctttgacaatttaaagggttccaaggaaacagctgaacctcaggaacagaaaggtattttttggttctgatttttgatgtggaaacagaaacacatatttgattttaatggttctcagaatggaaatagtggcttctgaatttaaatacaggcagcatcagatcttattattctgctatctttagccatttttgccttcatgcgttatttatcatttcactttcaataactttgatatgtaaattaaagctactgtaccaaatgttatgatttagataaagatctagaaacactaatatttctcattacggattttgcttatccagctgaatccaacggaattatccaatttgaaccatgtaggggaatgtctggacagagctcagcagacttttgagaccatttaaaatccaaacccaccacccaaagcttttctaccgtaagggcttctcagtttgttgatgtggcacattgtccggcgacttcaaaatcatgactcagctttctttttcaaatgcaggcagaatcattccctggcccagtttgaaaagttctgagacttcaggctcagaaaaatagttagcatagttgttgatacttcaggcattatctgcacttaccagctctgtgaccttggccaagttataacctctctttgcctgagtttccttaactgtaaaatgggtgaagcaatagaaccctctatgagtgtgaaataagaaaagccaagtaaaagtgctgacttagctcagtccctggcacatgataagcactaagtgttagtaaattattcttcctgaggcagaatgctgcaggagtggctttgccacagatttaaggattcactctttaaagactgagaaatggccatacagtcttcaatggactaaatgtttaggtcccctcaaaattcataggttgaaattctaaccccacgaggtaagagtattaggaggtggaggcctttgagagataatgagataatgaaagtgaagttctcatgaataggattcatgaataggattagtgtccttaaaaaggggctccagaaagatcccttgccccttccaccatgtgaagctccagcaaaaagatgaccacttagtaagcagacactctccaaacaccagatctgctggtgccttgatcttggatttcccaggctccagaactatgagaaacagaccaggcaagatggctcacaactgtaatcccagcactttgggaggccaaggagggccttgcctgacttgtgatcaggagtttgagacgaggctggccatcatggtaaaaccccatctctactaaaaatacaaaagttagctgggcatggtggtgcatgcctgtaataccagctacttgagggtctgaggtggaggcatcacttgcatccgggagatggaggttgcagtgagccgacatcacaccactgcactccagcctaggcaacagaatgagactccatctcaaaaaacaaaacaaaaaaagaactacgagaaataaatttctgttgtttataagccaatctatggtatttttgttacagcaacccaaactcgaattaagatacaggctcctagtgagcccagagagccacaaagaaagaaagtctaatgactctcttgaccactcatgctgccttccattgcccgtctcctgtgttctgtgatagtcagagtgaacattaagctaccttggtcactcaagcacctctcaggtgggtttgggtctctccgcctgacttcacatgtcaagggcttccttctggaaacattcggaaggcttcatgagaacaaggtggcccatgagttcttgttcagctaatgatcctgataccttggtgagcaagaaagagctatgggcagcaatggcaagacagggcaaggagcaatgggagctgtgagtctacttcaaggtcaatgaatttttccccagcagctgccacgtttcttccccaaataagtcagaacatgagaactatcactgaaaaaaaagactaaacatagacaatatttcatctctcaatccatctattcaatcatttacccactcgctgacatatcgttgcatcccctgtgcccagccctgtgagagaatctgaaatcccataaagatgcccaggaggcagccctcatccttggggaacctacaggctactggggtaaaggcctatcaataaacacagcccagagtgttatgggccatgaaatgctgagctgggatgttgaaagacggtagagacacaggcaaaaaggaggttccaggaaagggaattggcaggtgcaaaactgcagaagtgagaggggcactatgcattcttcaaagagaagaagggccaggagaatggtgtaagatgaacttcaggcctcaagggaacttggaggcaggctgaagcactgactgcagctgagggcagtggagggccatcccgtgacgcgtaggcaggaaagtgacatgctggatttgcatgttaggaagatcgttgcaccatctttaccccagtccacacttgacttcttccattgactgggcatctgcgacgatggctacatttacataaattctgatcatctgaccccctcagagacccagggttcctcatacttcagtactctttatttcaggtttagtcgagcggagcagagaggaaaagcatctcccagctggctgcagagctgcatttccagctgcctgatagatttcaccaatctgccctcccagagccagtgtgaactcaacacatccaaggccaaactcatcatctttcccaccaaaccagctcttccttcttagtcttccagtcacccaagttcaaaagctccttcttactacctgctacatcccatccctcaccaaggcctgctgtgtcttccttcagaaatgtccccacctcctccctttccttgcagtgccattgtttcaccctgtctccatgtcgtgaactcttcccacactgacccacctgtgtcctctgtccccatccccccaatcatcagcctgtcttccattatcaagtcacttcctgccaaaactggtagactgcaaactccctgcagtgtagaaccgatgatcattggtaaggcttccaagacccaagtagttgggtctcaaagaggctttccagcagtatctccttcctcacactcaccttgctgatcctcacactcaccttgctgatcctccccattgagcaaatcacccaatccacctatcacatcctactctggcttctgctcatagtgtctactggatcaaatagtgttccccaagaacttatatcaacctagaactttggaaagtgaccttatttggaagtagggttggatgagatattgaggtaaagcatttagcatgcagtctcatacttagtagcaaaacgtatactggttgacagcatcatcgtcaaccacaacaatcaacatcatcatcgcattatcattgaactttgttttaaaataccttgcatcagctacgaacacagagttgcatgaatccaccacttgcaagaaaaaaaaaaaaagaataaaaggcacccttcaagattaatgcccccactaaccatgagtactaagcaggttcttcacgtatcaaggacagtgtattattaccctcataaaattcctttcttcctaagagattaaagagctggggaaatttcattccactcaggttcacaagtcccctgagagagaggcaacaggtgagcatcacttttccattgtcctcaggtgtgtcaaagcagagacaagaatcaaggtggccatctctagagctggaggctgctgtctccccaggccttgagagttaagaaaacgtgggccatcctcctgcttattcgttaggtattctttgcctactctgaaagcaaattagtacgctgcagggtgttggttcttattcattcacttcttcactcattcattcattcaaaatcattgaatgagcctatgttcccacaaactctactaagcattaggcaggctacagagaataagaggagccagagtcaagtgtggccacctaagaaaatgcccacgccacaaatggccagagtctgtcctgtctcctgaatatgaatggggaatgcttctaaaacttcaccagtcttacatgtctcctcctgtaatttttaacagtggaatttaaaaattcaactcaacttcaataaatactccaaaagaagatgatcccccaaacaggagtctttcctggccagaagtaagacccaccagcccttctgcagccatcatgctccagaatcaaagatacacatgaagtggagatcgatgcctcaagtgaagatgctccaaggaatcagagccttttattgttgctcctacctggactgaaatgaatctgagcataaaatgagaggaagctggcaggtatttacagtcatagcagcatttctcatgatggcccaaaattggaatcaacccaaatttccacccatggatgaacagataaacaaaaatgtggtttatacatatgtgatggttaataccgagtgtcaacttgtgtctgtgagggtgttgccaaaggagatcaacataagtcagtggactgggagaggcaaacctaccctcaatccgggtgggcaccatctaatcagctgccatgtgactggaagaaagcaggcagaagatggaaggacttgacttgctgagtcttccggccttcatctttctcctgagctggatgcttcctgccctcgaacatcagaccccaagttcttcagcttttggacttttggtcttacaccagtgacttgctaggggctctcaggccttcagccacagactgaaggctgcactgttggcttccctacttttgaggttttaggactcggactggcttccttgctcctcagcttgcagatggcctattgtgggacttcaccttgtgaccatgtgagtcaatactccttaataaactccccattatatatacatccatcctattaattctgtccctctagcgaaccctgactaatacaacacaggatggaatatttttcactcctaaaaagcaacaaaattctcacacatgctgtaacatgaatgtaccttgaagacatggagctaagtgaaataagccagacagaaaaggacaaatattgtatgattacacttaagatgaggtacctagagtagtcaaatttacagagacataaagtaaaatggtggttactagaggctgaggggagtggggaatggagagttagtgtttaaagggcacagagattcagcttcaaaagatgaaaaagtttgagagatagatatcgggggtggttgcctaacaatgtgaatgtacttaatgccacttaaatgcacacttaaaaatggtgtgttttgttatgtatattttagccacaaggaaaaataattagtgggtgcaatcaggagacttctccaaagccatgagaagaatgggcagtgctattaaggatgctgctggtgtctgctcagttcccctttagtgagctggtgcactctaccctcgccctggggagttggctccttggcagcccacaggagccaccgggaggttattcccccacagactaatcaccatcaccatggggatggccagtggacctccatgaaggtgcaaaatatctcttgcctccaggtggaactgagtctgtggtgcatctcatgccccagggctcacccacaggcttggttaactttcttgccctcacctgcttgacctgcctcccttgctcttctgagagcaagccctccataaatcattcacaggaatccctgcctcaggctctgttggaaggacagtgttcctcaaccttgttttcattactgccctcctaaggagtctttttatgaatttttttttcctaatcacccactaacaggtacactgtatatctgcttatgtactgtatatatatctctgtgttttttacttaaaatattgtaatttttttcactctctaataactcatttttattcttttggaagtgagttcatctcctctgaacatgcctggtctacagaacctgagctaacgaagtgtggattcgcctaaatgacccatgtgtggggtatggaattgtccctcaaagcatcgagagcttcaaaatgatttctgctgccatcaatgcattttattcacaacaagcaaccagcaaaccagccaatccaagaaaatataaaatctgccacctcttttgtgcccagagggtgtgctaaaccctgaagagacagaaaacaatgaacaagccagattcttgagtctgcttgcatgggaaataaaagaacaaacaggtggtacaatagctaagacagaaagtggggggtacatatctggaagtggtctaccctacccagagaccctacctttttggagtctgtggaccctctagggatacacagagacaacagcaattcactttgctgtcacaggataagcactccttgaagaagaaaagggagaactactgctgttactgacttgttcactcattaattcactcagcagacatttctgagcacctactttgataccctacactgtgctatccctggggatacaatacaaacgcagcaagacatagggagctagaagaaagggctccaggcagacagaactgggtttgagtcttcaatggctttgtgatcttgggcaagttccttaagcacttatgttcctgatctatgacatgaggagaataatagcaaatatctcaagggattgttgtgaggattaaatgtgatactgaacataataaggcgaggtcacttattgtcttaacacacagaaaatactcaacacatactaggtattgctgattctttcattaccaactggatacattcccttccgtcaagtacttggtggagagataatgattaaaacatagtgccatattgaatcatgggaaaaacacatctattctctcatttttggaaaaagagttccccctgaggacctggtaaccacatggcacttccctgacatgactcctggccattcactctgatggctggaaccctcctctccaagtctgtcgctctgttatctgcatataacaagataagcctacacttccagctcatttggcagatactatgaggaactaatgcctgcaactgtcaccatttagtgaaagatttaataaacggggtattttttcaagtccaatttcacaagccaagctgatgtttcattcccccagcattaatgctgccacacgcacatcaaaatgggtaccaagggacagggcattattttccagccacagtgagacacccagtgacttcagagaccacagccatatatccacatgaccagacgaggagaattaaaatcggcattccggggatggcatcaccaacactgagtttcagggggttatttatttattatgtgataatggcccaaaggtatacactactccaaaatctgccatgaaaattcaaacatctttgtaatccctgtttacaaagcatacagagaaattaaaacaggcttaatcgagcagtgtttgtgcatattaatgagcctaaattctaaatctggattttggaaataaaaagggtaaaagaggattcatttcagactaatttgtttttgaatatgacactttgcatgtcaaatagtataggggatgtgaaagtgggggcctagataagcattttaaagcatttccacacaaagtatggggcataagatctgttaaaggaaaagaaccactttccatggtctacctaagactttaatgacacaaatctctcttcagtctcctgtgtcctgttcagtgagggaccaataaccgttctccactgtgaccatagaatccttctcttttatgccctgtataaactttcctttggctaatcattatttacaatgctataacatgagtgctgggtgtcataagagacatgttcttttaacttgtacgctaaggcacttgtatcttagaaaacagagaggtagagggaggccagcctccgaattcagaatcagatagaccagagttcaaatctcagccctgcctctcaccaactacaagttatgtactctctcctccttgcttcaccttccacatctgcaaaatgaagtgataattcctatcttttcggccaaacttacaaaacagaacatagtaggtgtgcaaaagtgctaactccattctttgtgcttttctttggagcaataataaatcacggagtgaccaaaagtattttacgggtatcataattcagtgaatagccaacacccaatttcctatggtccatgtatgcaggaaagttaagagaaaaatcaaaaagatcccaaaggggacacttgggaacggggatggatattgggatgggcatgaacatacacacacatgtgccctctggcttgctttgcttagcataaggtgcatgatacaagcctggcaggcctcccgcactaaataagagttagatgtgggactgtggaatcagatatcctgggctagactccatgctctgccccttacaaatgactctgggcaaatcacaccagtcacagcacccttccagagactggtgtcctcactgtaaatggggacagccaatgcaacctccctagctttgcaattcatataagttacacctgtcagcagattcctttgcagatataaacataagataagaaaacaggcctgcaggattatgccccaatcagaaaggttcatagaataagaaaacacactaagtatttcaaaaagaaaaaaaaaaaaaagcccacgtccacattgcgacatgtcccctctctcagaatttgaccttagggatcccagatggttccagaccatccccaagctgaaagcatcctgttctctcctgaggattatctgacctgagagccccctgcccccttcactcataggtcctgtccaagggggtctacagatcacacaagagttcagagtttggggacagggggtatggagcaaggtccccactgggacagctgcacccacagcctccccctcttttccccatgtttcctccagaccctgggcactgtggagccaagagtgggctggccatgctgccaagcaggacccttccttgctctgccatcaggctctggcttataacagattctcactgttccaaccagcctctccccttgcctctggccctctccctctgttacttccctctgctgtctcgcctcatccttcctccctggactgtggtctcccctttcctttccctgcctgcatcagcgtcccctcctttccctaccacagctctccatgcctctgtctcggttgctgtctctgactctctgtctgctcatttctctaactgctctaaggccactttttttttttttttttttttttttttgaggcagagtctcattctgtctctatctcggctcactgcaacctccccctcttggcttcaagtaatcctcctgcctcagccttccgagtagctgggactataggtgcatcaccacacccagttagtttttgtatttttagtagagacaggatttcactatgttggccagggtggtctccaactctgacttcaagtgatccgcccacctcggcctcccaaagtgctgggactgcaggcatgagccaccgtgtccagccctctcactgcctatctccttttatgtttctctccttccctctctgtcagtctctcattctctttctcctgatttcactgggtattcccccatctctgtttctccctttcagggcagggactagggtgaggttggggtggtacttgacccaggcacaaaatttaaggaggtgccaaaacactcagtaatccaaacaaatattactttaatgtaatatttttaaaaatcaaaattaatgcaaaaaaaatccctgttgaacaaagaatcaaaaatacaaggaaagacaggatctgtccaccactctactccttgccccaacctaatccattcctagtctgaaacattattgacaagaacaggtggctggcccatagactgtagttcatccatttaatttttttaaatattgcattaaaatattactgatctcgatgattacattctgtgtaaaggggcatgctgcctgtgtttgggccctgtgacctttctgtgcgtttccttccctgtctcttctctcattcctctctgtttaccctcaccctccttctctgcttccgcccaatcgcatctccctccctcctccggcccacctcggtcttgctctccatctctgcccagccccgtgtgtgtttgcacaccttgtccctgttatgtctgtctgtcttccccctctgcatctgtttgtccccacttctccctgggactgactttctctctctcccttgtcaccctccccacctctcctcacttgcctgcacctgtggccatcccgtcaagcctgagcactgccaagagcacaaggaaggacagacgagcttcctcctggcaggaaagctggactgggagggaaaagctccaaattccatcctgtctcagacctccaaatctgcaccatctgccagagctcctgtgaagcctatcttgagcaatagatgccctgtgtcccagaggtagaggaggaggcagctggcagatgctgaagtcacacgccatggatagaagacagtgggcactgaggcagtgcgcagagcaagcctgctggcaggagctggaggtgctgcagttgggagggctcagattcccctagaaagggcaattcaccctccatgtggccatctcaggacagcaactagagaagtgtcacaggtggtatctgcctaacgtgcctggatgtgtcggggatatcatactctctgtttaacttaaccctaggtatgatttttcctattctgcaactgaaggaactgcagttcagagaggttgagggatttgcccacgggctcacagcttgattcaaacttagaacatctaagggtccaaaaggtctgaagaaccagcccagggccctttcctttaccatgttatctatttaagaacaaacttctcacaaacccagaggaataagaaataaaggccaagcaacccaataactctgtgttcattttttggaaaacaacgttcagagttggctaaatgatttgaaaaaaatattacattctccagattacaccaaactcagaataaattacaaatggattaagtaattaaatgcaaaaagaaaaacataaaacatctaagaagaaatacaggactgtatcccatgatctgaaggatgaaaagactattttgagggtgacataaaatcatacaagaaaaggttgactgattgcattttttaaaattgagagttttcgaattgcaaaagacatcgtaaacaagattgaaaggcaaatgtaaaatggcggggggtgggaatcttcagtctatatgataaaaggttaatatccttaaaatgtgaagtgtgcttatcaaccaaccaaaaagtcaaataactcaacagaaaatatgaacaaaagatttgaacaggtaatttatggaaagcactcaaccaaagcaaataaacaagaaaaacaacgcaaacaaaactcatggattcaaaacttcaagttaaactgatacacctttttttcacatttgaagttagcaaagcttaaatattcactatcatcaagagtttaaggagtggaaaacttttacaggattagggagaatggatattgttacagccctctattgggaaatgtgacaatatttattaaaacttcaaatgcacattcctgctgatccattcatttcactcttcaaaatttatcttactgaaatacatatatcacatgcacgtttatcacaacattgtttgaaaaaaagcaaaatatttgaaatatcctaaatgccctacaatagtactgagtaaattatactatatctaggtaatagaatacaatacactcaataaaaggagtgaagtaaacctatatgagctattgtagaaagatcattgtgatggttgatttgggatgtcaacttgactggattaagggatactcagatcgctggtaaaacattaattattctcagtgtttcagtaggcacaaaacccatcccatttctgctaaaagggaagccaaggtggtttggcatttgattagaataattgggctgtggccgggcacagtggctcacaccagtaatcccagcactttgggaggtcaaggcgggcagatcacgaggtcaggagattgacaccatcctggccaacatggtgaaaccccatctctattaaaaatacaaaaattagctgggtgtggtggtgcatgtctgtaatcccagctacttgggaggctgaggcaggagattcacttgaacctgggaggcggagattgcagtgagctgagatcacaccactgcactccagcctggcaacagagcgagacaccgtctcaaaaaaaaaaaaaaaaaaagaataattggactgccccagctgtgtctgtgagaatatttccaggagagactgatgtgtgagtccatggactgagtggcaaagatccaccctcaatgcaggcagcaccatccaatcagctgagggcccagatggaataaaaagctggaggaagagtgacgtctctgggtctcccagagccaggagcgtttcttctcctgcccttgaacatgagaatttcaggttctctagcctttggactctaggatcactccagcaaccctctgggctctcaaaactttggtctcagattgacagattgatagtaacaccctcggcttctttggttctgaggccttcagacgtggaccaatccctgggtctccagcttgctctcagcctccataattgagtgagtgaattcccctaacaaatcccctctcctctccctctctttctatatatatgtgagtgtgtatgtgtgtgtgtgtgtgtgtatatatatatatatatacatatgcatgtgtgtgtacatatgtgcatgtgtgtttgtctctatataattacatatataagtaatatgtaattatatatgatatttaattatgtaatatatatatatatatttatgttatatatatatttggttctttttggatagcccagactaaaacaatattcaaaagaaaaaaatgtagaacaaaatacatagatattatgatcccttttaagaatacatgtttatgtgtgcctgtgtatttatacgtagggaaacagacctagaggcacagacggcaacagtgcatgcatcagggaaagggagggacaatggaatactcactcttcaaacatcaccctactgtttacatttgtacaatgagtgcctgttacttctgaaatcttaagaatattcccataattaaaaagttggcagacgtgatttaaaatagaacagttttgcaaatggaaagcaccctttccaccccaaccctgccatgccccaccaccctatctgatcagtgagagcggcctgccctaagcatgctgggaatctgagataccgctcccatgcacacgtgacatgcatttatttgtaattaaacttatttatgttttgaggttttcaaggccccatgacatattctgaagcaaagctagaggaggcactgccttttatgtaatcaatgcttcatattttgtgttttataagctctatctttcccattgtcagaaagatcctattaaggatgatgctgctgctgctgcctattttactgaagaactttaggcacctgcttagagccaggattggaacccaggtctgttgtacaataaagctcacgtccatttcaacccaagccctgaagatgactggagacactccatgccaactgaccaaaccagattcaaagatactacacagaaactgcttacccagggtactattaaaatcaagaatatccaagatggatatattaaattatcatgtgtatcctccctaaaaaatcaacaattaaataaagaaattaagaatacagagttaatacctactcaaaggagatgatggtgagacctgataaggtaagctgacagagaaaatgctcctctcatacaaaccccatctttgcaaagtcctgatttgagagactacagagagaggccctacagaaggcatttcctaaacacatgttacctcaatttgttgaggaactgcaactgtaatagctgagcctgtcgctataaaaagttctggtcttttccctcaggttaggaccacctctcaaaggcaagaacctgataatttttgcccagagtccacactggagcccacccaccttggaaaccaacagtggacgtgaactcagttggatggggtaggtcatacttccagacaagcagaggaccagggacaggtgggcaagttccctggtctgttctgcctgggccccagatgtgagatggctgaatgggggctgggctggggtgtctcaggggccctagttaatcttggccagagtcctttccaacctagccctaacagaagagatacagacagttaaggtattcagatcactgaagcattgttactaggtgtaaatattaacacctgcactcaactgtaacagaaaccaaattaaattaacctgacctgaatgaattagggttttatttttctcacataatgggagatacaggaaaaaaaaaaaaaaggctacaggcattgagtcaagggtgtatggttgtcaggctgagaactctgcaattctctatccacatagtgtccctgttgtcacagatgactctccacctttagcatggtatccctgttccagccaggacagaagagcagggaaaaggacaaaagaggtatgagctactgagttggcttcccttttaaggatctttcttggaagccccacccacagctttctcttccacctcactggccagaactccatcgtgtggtcactcattctgcaaagaaggctgggaaatgcagctttgaagctagacacattttccaaaatagtcagaattttctagtgagggtatgcgaagaatgcatattgggtaagcaactagcagagtctgtctgaccagataatcaatggggataaacttggtgaattcttcagtgcactgatggtggaatgggtggcacataagattagaacgccctggattgctggcaatgggcccaattgttgcactagaggagactctcaaaagtccaccaacacaaggaaggcaaattatccttgcaccatagacacctgtggcttttccagtctcatctttgccctccagagagctagatactgagtagaaactaataacattaagtattaataggccttacatgattctatttcctttttaactgaggtccaaagatcatctaaggtgatggtacaccagtaacctaagaagtaaaagagtaggtcaaattgcttatcctatgtctggagagggggctgattccaagagctgagcatgctgggaagaggagagtctctcccagaacaggcagagaggacctgcattatggcaggggaggagttatctgatcccatcaggaggcggagtgaaagctagaagcaaaaatagaatatgtggccaaatgaggaggatgtaacagctgggtaaaaaagcataagaacacacaaggctgtgtgggagggtgagatgccaggcagccttcagcagctgcagactttgtcttccaccttgctagagcctgatattgaagagttggcaacatggttactccagacctgcagggatttaaagggatatttaaagggatgtaattgtaactcccagatgcctgaggacactaagagtgcccagccaaggcaaaatggttccaggggcaaaggccctcatagcaagggcaggtccctccagcctaccagcctatctcttctgaaagaaggagaaaagatatatacattgatcttgatgttaagagcttctttatcctaagaaatatgaaggaccagaagtatgaatctgtgcttgatgattatagagatgtgtgtaacatcgagtctgcaggaccagacccagccataacagaaaatggccctacacctctgaagtgagcccactccccaaacaaggtagattgctcagcctctgtgacttgaaaaactttgacctattttgcataatgactgtgtgtgacctgaagcatcctcctcaacatttgtcaactgcatgctcatgctgttctggcactggctgtgtgcaggtcataagtgtcagcttcatatgagggtaaaccaagtgctcatcccctctgacaggcacaacaaaagatgctcccctctgaggccaaataggtggcccatgctgccaagatttcctgctcacacaagcctgcagaaagtccatgttaatttccaatcatgttgcttcccttcctgagtggaactgagacaggtgggacctgaggccggctggttacttggcatctcctcacactaatgttccttaaatatctgttcaatgtttagagaagaggcagagagctgcctgagcaagggcctagaagccacggctgcttctcctctcatctccagcacagttcagctctggcccaattctgcatctctccctcaacgaagccctgtagctgccctaacctctccccataaaaggtagctttagaggctatgtcttgttattggagatcaccccttggcctcaccctttaccccagatgtctcatcaaagtgcctctggcccccacactgaggttcccccgagacaaacatcctggtaaatatagctttgtgtgctttcattatttattcccagggatgcctaatgcccctgaattgcctggcatcttggctctgctgcctgtcagtggatgtgtctctgaggacagcaggctccccacagtctttgcagcagcccaacacggggagctggggaatgagcacagtgagtatgagcaccgtatccaaggcacagtgcctgggtgcaaaacaaacccctgctccaccacagactggctctgagaatatgggcaagctactcaacctctctgagggtggcttcctctgcataatggagcaatactagtgcccaccttatagggttgttgtgaggagtaaatgagtgcatggatattgttcatcacagtagttgacacaaaaccaaggcagaattagaatttaatattagtatcagtgttactactaatgcaagagggggtaaaaaaaaatggctccaaggctggtagatcatgaggtcaggagttagagaccagcctggccagcatggtgaaaccctgtctctactaaaaatacaaaaaattagccaggcatggtggcacgctcctataatcccaactactctggaaactgaggcaggagaattgcttgaacctgggaggtggaggttgcagtgggccaagatcacaccactttactccagcctgggcaacacagcaagactccatctcaaaaaaaaaaaaaaaagcctcacaaacattcccatgtgaattgaatatgcaacttaaaatgcttacatgaaatggtattaataaaagtattgacttgagtagaaatgctggcttggccactattccattgggcctgcccaatgtccagtgttagatcccaagagctggcaatgagactcttccaagatcatccccaatgccatttctcaggccaacacatgctaggctcatcacaacctcacagctgccaatggctccagcttccatgcccagcccacccctgggagaaccaactctgtagcctcactgggctgctttgggtacccaaaatgtaccatagacttcctggtctcttgaccatgctgttccctggctcttctttgccatcctgaaaattttaaacatctcaaaagatcattcatacactaccatctttccaacaccttccttgactgacagaaacacagccatggcctttctgtggtcccagaagctttgttggtgtctgtatccacttacaggataacctgttctcccaatagacaatgagcctcctgtggaatatatctttagctcaccatgcctgatactaactagataccttacaaatgtttaatgattaaaagaagtattagaggtaagttttacttggcttgtgcacagctgtgtatgcacaaacacatacacacaaggtctcctaatgactatgtgaaggcaatttcaatgtggaaaatacaacagtatcacaaaagttcagtaagtcagggaaaccaacttccagaacgcagtccatccttttacactgatggtaaaagcattagcagcactttggcttgtgtggtacttaacagtttacaaagcacttataaatggaaggaccctgagggttggagttggaggacacgttctcaacatctagcctaatttcctgggtaaagcaggaatctcctggaaaaaatcatcactcagggttctgtagcctcttgccaatgcatcctgtgccccagagtttcctacctttcagaataattcacagtatttttagagatctctaatcattcaaaggttcctgtcttaggttgagttaaactttgcttcccaggacttgtcacctattagtcctggaatatctctcaggaacacacacaaaaaattttcttctggcagaattcaaattctattggtaactgtcatgtccaccctaatcttctgtgaggtgatccatccccagagcttcagtatttcatcctttgacttggatctcagacttgtcacctctctggcacccttgcttaggaagatgctacaccatccttctaggaaggatgccaacaggtggaataatgcacacagcaggtgtctgactggaagaggaggcatcattcacttggatgtttaggtctttagtgcagttatgtcctgcctaactgttctgggatgaattgtggccccccctccaaaattcatatgctaaatccttatccccctagtgcctcaggatgacactatatttagagacattattgttttgttttgttttttctctgagacggagtcttactctgtcacccaggctggagtgcagtggtgcgacctcagctcactgcaacctccgcctcccagattcaagcaattctcctacctcagcctcccaagtagctgggattacagatgcgcaccaccacacccagctaatttttgcatttttagtagagacaggattttaccatattggccaggctggtctcaaactcctgacctcgttgtctgcctgcctcggcctcgcaaagtgctgggattacaagtgttagccaccgaagcccagcctagagatagaatttttctaatttttaatttttgagagtgcgtagtaggtgtatgtatttctggggtacatgagatatattgatacaggcatgcaatgcataacaatgataataaccataataatcataatcttaagtggggtatctactgcctcaagcatttagcctttgtgttacaaagaatccaattatattctcttagttattttaaatataaaattaaattattggctgtagtcaccctgttgtactatcacatagtaggtcttattcattctattttttgtgcccattaatcatccccaaccccttccacaccctcacttcccttcccagcttctggtaaccatctttctgttctctattgttttaatttttagctcccaaaaataagtgagagcatgtgaagttggtctttctgtctctgggctattttactgaacataatgacctccagttccatccatactgttgcaaatgatggtatctcattcttttttatggctgaacagtactccattgtgtatatgtaccacaatttctttttccattcatctgttgatggacactcagttgcttccaaatcttggctattgtgaatagtgcttcaataaacatgagagtgcagatatctcttcaatatactgagttcctttcttttgggtaaatacctagcagtgggatcgctagatcatatggtagctctagttttagtttttaaggaacctccaagctgttgcagagaaggtctttaaagagctgattaaattagacagttacagccaggcacggtgattcacgcctgtaatcccagcactttgggaggcagaggtgggcagatcatgaggtcaggagtttgagaccagcctggccaacatggtgaaaccctgtctctattaaaaatacaaaaattagctgggtatggtggcgggtgcccataatcccagctacttgggaggctgaggcaggagaatcgtttgaacccaggaggtggaggttgcagtgagccaagatcgtgccactacactccagcctaggcaacagggcaagactccacctcaaaaaaaaaaaaaattagacagggtgggctttaattcaatctgactggtgtccttatgagaagaagaaatttggacagagagagagacagcagggacgtgtggcacagaagaaagaccacgtgaggacacagaagttggccatctgcaagccaaggagagaggcctcaggagaaaacaaacctgccagcacctcaatcttcaacttctctagcccccagaactgtgagaaaatacatttctgttgtttaggacactcagggtatggtaatttgttatggcagcccctcataaatgaatacactacctacatgtgtaactcacttctattacctacacagcaccgacagcattgaagttgccaatttctggtcaagagatgagtgacaagataccttctggaataaatctcagagccagttctgctccctttctgagcttccaaagaatgacatgcagccccatcagcatttccatcccagcactgcccgtcaccctaagaaacacttatttctctgttgaagcgaaagacccttccctgatacaggccagaattttccgaagtaaggtctttgtttttaatgaaacataaaaggacaggaagaatatcaaatcataaggcagacgagtcactgctaagtcctttaaattatcatacttgttcttataccacccatttagcctaatggagaacagagggcatgccctattgtctcctgcatggactcagttacgagctgctctccaacatatggagagaggcccttccagatactgcaagacatggagagaggctcttccagatactgcaagacacaagcacacctacttggagtgtcccttttgtccttgctttgccctttgaacttgatgcatagcaatattttcctagtaacaaacttggttcccctcccacctcccaacttccctgaagtgtcacaggtaaaatactctctcttcctcgacctagttctagaagcctccaatatcctgcactatccttacccctggtttatcctcatcttagggaactgaatgctactacaaagtagatccccttttaaaatgacataagcactttggtcttctccccagggttctgctatttcagggagacaagcagaggtcacaaagcatctctagaagtaaaatgccatccaggggttctgggccaccaacagagctgctaagtgctacttcctttgtcctgggcatccgatagcctaaggcaaggtacagatccctaggggctgaagacagagtgaatcaaatctgatccaaacgcctaggagcagcaagagctaagttgagaaaacctccagtaaatgccaaatctgagaccaagaggagaactgaaatcagggccacggctagagggaataagtgaaatggaacaacagggaggcagcgatggaatgggacagtctacagacacgggtcaggaagaaacagagtcaggcttctcagagtcaattctttatgcatcaccccttggagtccatcacccagaaagaaggctgtgcatcttcaagtcagggcaggaaaagaggagagtgggcagtcatccatctacctcctctcagctgcctgcccagaggtacaagctttgaatttcctctcctaaccatgagatctatcttgtcactaggattttctgttctttccacaatttattccaccttgtgaatgattggaacaaatctttaaaagggcatttttcaaagccatgatggtacagtagtcacactgtctggccctgacagctctgaacaagtcacaagcccccaaattacacggaacagctgtccatcaagtattgccatagtctactggctgcttgtgagatacagttaagtcatgcacacaggccacccaccaacaagcaattgtgattggaagtgcttcggctttcatcaccaacttcggcagcagagaatatggcatcacgccacaaatggcagcttccagaaacaaatcagatgtatcacgtagcacttcattctcctaccttcaatggccatgcatcctgcaaactggctccaaaagactccagggcagttagatcggggtatcacttgtatatggccgtacagtctacggtaatttgtattattgttcaaaatactactgaccaagttttctatctgcccctgccattgatattagtcttagccatgtaatttggagtgtttctccttggaggaagattatatatcccagaccctgtggtcaaaggcttggccttatgatttctggcatccttcctaatggaagaacatataccctcactttgctgagcttaagagtggctacgtaatttgctttggtccattaaatgcagacagtcatgtgtcatttccagtttaaaatccagctcatagttttctgtcagtttttgctctgttccacagaccacctatttccgagatagaggctgttgtatcagcctaagtaccagattagaggccatgtaaggtatggccacagccaacctgatatgcagcatagatgaaaaatgaacttttgtggttgtagtttactgaatggggaacatttattttcagaggttatttattattgaagcataatctagcctatcctaactaaaatatcttcttcctttttctctttttttcttccactaattaagcacctactaaaaattgagaatgctttataaattgagcacctactatgtgacaggtactggattgggcagggaatgcaaataaaagacatacctaatgggaagacccagatgttgcacaaatacattttgatacattgtggcaagttttacaacaagatgcatcagcagcttgaaggaagccattgctctgtcttctctatcaggagttgtggagggcttcatagaaatacccgtcatatatgatgctccaaaaataaataaggttgattgaatgactttgatattggggctaactttaagaaaaagatcaggggtttggttggcaaggaagaaagaaaatggcattccagtagcccaaaagggggaaagggcatttcagaacaaaaaaaaaaaaaaatggcataagccatgttgtgaatatacctctgttgttcagtgaggatggaacttaggatggacagatgaagagttagataaaatgatttcagataattccactggaatcaggttgagaataccgaaaggccattccaaggaggtttgacttagccttgggggttatggaggaacaaatggagacatctaaagcaggggaatgaggtggtcttcctgccacaggaggtggtgtggagcaagggatgtggctgggtttgggaatcacaaaaaatggagttcactctgggtaacatgagattacaacatttagaacagcaaatctccagtggagaaagggaaaagcacaaacccaccttagatcagcttccctaagcaacagactctgaaaaggagatgagatgcaagaaggaggtttactgaggagagctcctgagaccatcacctggaaaggagtgaaggatgcaggatggagcagaggaagaagtccagctgtgatgcagttgcaacatagtccatggctgatcacctagggagctctaaactttggatggcccatcagagttgtcttgaactgaggcaagagtatcagaccctcatactctcacatcaaccaggctttggatatgggttacccccaggaaagaggtgtaatcttgggcaagggacctcctttccacagaaggacgttaccaggacaagattctgctaagctgtcggtggcagtacacactcttagcagctggggcagtgagtgcctgggtgctgaacagggaatcagaatcttagaggcagctgttggcatccactacacaccctcacacggaacaacaacttgccttccaccaagtgaagacacagcaacaaggcaacatctttgaggcagagagcaagccctcaccagatactgaatctgctggaaccttgatcttggatttcccagcctccagaactgtaagcaatacaattgcattgcttaaaaattacccagtctaaggtatttcgttatagaatgctgaagggactaagacactggcacaacactttccagtacgttctatttttacagacaagaacatggaggttcagtgaggttacattatctgcccaagtgaccatggaatcagactgaaatttaactttagcagtgtctgactcagagcctacattctccccatacattttggtatttatcttcaaaaggtatgaatatctctatacaggggccacaccacagggaagaccaaccaaaaggacaatataagggactgtctctgaagaggaagacctccaatgccctttcatgggttctcaaaaacacctggggtctgagtctgatcagtactttgaaatcctgctgctcaggggtttctgcattaggtaactgtactccccaaccacaaagcctctccatgaccttcttccctgccccagtcaaggcagaacttggcttggaagggagctcagtgaagactgggcaataggtgacctgagatttggggcagaacggccagaaatcatcacaggcaccacgcatgactatgagtaccaggcactatcacccataccaccccattatcactcccattttacacttaagaaaactaaagcacagaaacctgagtcccttgtctgaggcacataacatgtatgcagctgatccagaattttgttctttcttcctggacctgcatcaacacagagtgaaacaaaatttaaacatcagttcctcaggtgcactgtctacatttcaagtgctcagtggtcacatgtggccagtggctatagtgggtaacatattgagtaggtcaggtctaagaatatttccaccattgcacaaaattctattgaatagtgctgataagggctgctttgaggtcctgggggagcaaaagagcctcggtgattatctaaattttctctatgcccctcacccactgtcccaaatcttttcattaaaaaaaaaaaaaaaaaacagtggcaaataaacctaattaatctgaggggggaaatatatataattaatccagaagggagaagggaaaccatttttgtacctgtttatgttcacttgataaacagaggaaagctaatgcctctgtagttccagaagagtccacaggggaattggaatctcttatcttagccccccgcagagcgtcaggcctgagatcaaagcagatctgtgcatgtcattactgcatatcctccccttccctcctacattttcaagtcttcttggttcagaagaatggcctacattagcctgcccgtaaaaagtgaagcctttatttcacaacaatactaataagtaaaagcaaaatagcagcagctagatgtccagctccctttccagacacctcccagatataaacgcatgatgtgcgatacagaattgcagaggtcttggcggttctctggtccaaatttccatctataaaatttatgccaagccattgtgtccttaaacttgaattaatttgaatgtctctagcagtgtgtgtgtctgtgtggtgtgtgcggtacctgagacctcccaaagaagacaactctattttgatacctacaaatgtcacaatagaggacttttttggatacatcttttacgttgtatccaaatttgcctttttgtggccactgcccatttctcttggatccctctttggggacctaaagaacaagtccagggccacatgtcagtagatgtgaagacaagacttaggaccccttgagccttcctctctgggtctctctcctgatggtctcaaggtgtggctttaatacctctctccctggcagcttcctcccttcgtgtgttcagttgcacctgcccacctcctgttgagagatggacagccccacttgagtcccagcctgtaggggaatggaaacaaccctctccaccaccaggacccataagtgaaggcatttgggagctcacaccttcagaagctgccacaccaaactgccctgtcatccgcacagggactcccacccactgtgcatctgcttctggactccttcctggtttctcataataaagtccaggttgggaaggagcaatgttaattagttacaagttgaaagctattaccataataatgaaaagatgagtaaatgcacaatctccttctttcacagaggtatttacaaaagaaagattaataaggtaattttacctccaaatctgcaaggagctcagcagatgaagcacagagaagatgggaaggtggaggcagatgctaaggtcatcaggaaggagggagggtatccctgctctacagaaaaacactgagcgcagtgaccttaagtaactctcaaggtcatgcagcaagtggtggagctggaattgaaaccccggaacatccaaccccggccctagagctctcgctcctgaccaccctgctgcctctcaccgcactacgccttcaccttcataatcccaatattgggtagtgggtactggccccattttataaaggggaagactgaggctcagaagaataactcatttgccccagccacacagccagagaagctctaagagtctgggtccgggggcctctgccctggagctcatgctctttcctgactgtgtgttccattctagaagaaatctgtctttcctgacccacagaaagaaccatccaaggaagtcccagatgggggtacacaaaagtgatttcctcaggcagccaggtcacaatagcttctcagtacaagagcccagactttggcataaagttcaggaccaaaacgcacctagaaggaaagagggaaaccccctccctttgatgcatcttgtagaggcagggatggctgaaactaaccaggagctgagccctattcacgattgctactgctgttacctgcctggtatgtgttgtaggctggggaacacgggaatgcctggtgtggctactgcagaaaaagtcaggactctccaaactcctacagtcctccaagggcaaacgaaccttccaggaggtggaattaaataaagctgagagatgatgtcttcactaattaaaaaaaaaaaaattaaacagcctcaggattcagaaactgaaaggagagaaagccctaatcctaatattaggctggtgcaaaagtaattgcagtttttgccataaaaacagcaaaaactgcaattacttttgcaccaacctaatatttcaaaaccgtgaacacagatgttagaggcaaataaattcacagtagaatgaaaaagtccaaaaaacactaatgctccacctctcctgttgaccaaacccaaggaattccccacttcagcactccggaaccgggttttgtctgtgcttagctaggattacttgctggagaggggggtccctgtctgtccccacaacgcctgccttcacccctacctcaaccccacccccaccttttcctcagcatgtccaatctctacctatgcttcaacacttattagtaacaatgctgggattaggggactcacccactaattctacccacctccagtgcaatgtgtagaggagtcacagcagaataaacagagacaaaggaaaatacagcactacttcccggttggctgggcttgggcacccaactgcaactctgaaacctcagggaagtgagaacaggcccctcgtagtgccccagcccctcagcagtccagaccaaaggaggctggcccagcacaccaagccatgaacacacctgagggtctgcaagaacactcccgcctcgaaaccacccaggaagtggatccaggccttaccaagagcacttggatactttagagtgtctggaggtctgtgttttctcaactctctgtatcagaggtcagcaaaaggcttctgtaaaggaccagagagtaaatatttcagaatttgtgggccatacggtctctgcggcaactgctcaactctgctactacagcacaaaagacaataaaactttatttacaaaaacaggtggtaagttggacgtggtcagggtctggtccctgccacgctgtcattttctggcctctgttctagaggacaagagttctgtctgattcatccttgtttttgcctttcaacactgtgggtatttcataatcctttgcggaaggaagagaggaaatttgttttcaaaaaccagatgaacaaaggtaactactgagacctgatatgtcctaaggtatgcttggatgtcaaagctaaaagattaagtgcaaagaagttcccaacagtttaagaaaacagaatttggagtccactgagcaaggttaattactcttctgtgtcaatttttttccacacttacagcaagccacttagttgaggaaaattccagataaagcaccattattcaaaatgtacatggcatcaccataatgtccaagactgatttcatgctcctgtctggaagctgaggatggaaaggagtttgccctgaaccataaacatacactggataccatccctggaccagcaatcacacaccagtaacactcattcccctgggcaccagggagtctgtcccagcatcagtgaggggcccaaatctaaggacaaaggcaaatgcagctggagaaaaaactccttcttgaatgcttccttcagagtcagcaaagaaaaagcaacaagattatattttatgtattatgaaactgaatgagctggtcatgtaaatcacttgttgctttaaaaaaaattttgttttgctatgtattttcctcactgtgtatcctggtgtctcactgtgtatcactgccccagctggagtgcagtgcttattcacaagtgggatcatggcatactacaactttgaactcctgggcagaagtgatcctcttgctgcagactctaaagtagctgggactgcagatatgcaccactatgcccagctttatttttagattgccttcccaaaaaaggagaaaaatgcaacctggtccatattattcaattttgatgggaggaataactgtcctcaaatttgtcataaggttttgtaggatgtagggtggaggcagaagagaagaaagaaagagaaaatttaattttgtgtttaagaatttacaaaaaaaaaccccatgaattccaaagattaaattctacagctcacaatggaataaaatctgaagttagctatgaaaggttagatatttaaaaactcaatcccactcaaaaaccttaaaacaataggctaacctatttcattaaggaggaagtaaaatataattacagactaggtaggaagatggagaaaaaataccatttaagactttcaggttgcagttaaagctgtattcaaacaaaaatacatacctgacttttcctattaagttagaatgaaaatttaaaaaaatggtcaatcaacttataagtttaaaaaatacagaaatgcaggaaaatgaattaataaactgaaaagaatgtttaataaatctgaaattttctaagtgataggattgattcatataatagctggttcttttcaaaagaccataaaatacataaatctttggcaagagggaaaaacataaacatacaacattagaaattgactaggtgaattgccaaattcaattcttctttcattctgcaaatattcattgatcacctgtaaagtggcaaaaactggtgacacaacaatgaattaagcaaaatctttgctttagctccctgtaaaggagaaagataagtaattgcatttatggcgtgttatgaaacatatgcaaattttatgaaagactactatgtgaaactatgctaggaaactacatctcctagaaatgcactattttacaggaaaatataaaatcaaaactgatttgactacataaataaccgttattctaaaacttaaatatttatcaaatttgccttcaaaaactgtgcaatgacaggtggcttcgcaggctacttctgaaaagccttcagggaactgatgattctggtgcttcataaactgatctacagccaaagcaagagagagggatctcgtgcactttaagccaccagtaaaaccctactaccaagctaaagtgggacaaagcaaaggacaaaacagcttcactttgggatgttaaagctaaaattgaatacaagtctacagtcttatccagaattctgaaagtgaaaaagttctgaaacctgtttttttttgtttgtttttcataagtcatctggtggcaatggcctgtgctgtccacactcccctctcttccacataaccctcattgggtacacctatgacagaggcatacaggaacgtaaaatctccagcttccttgttccaatagagacagccctaaagagtcacctatactatttccagaactcccttgtgcaactgagctagagtcaccttctgtgggactctgcgtgatatcatacccttgttggtctccttctcttccatctgtttttcctgagaacacttctgaatcaaccattctcacatgaacccttgtctgggggtctgctgctgggaaacccatcgtaagacagtaaaaaaatctgacctaaactgcttctgtggctacacctgacctgagcctatttatagcattatttatctgacttagctttgcagtcatatgtttggctgcataaatattaacatgtttgattaaggagcacttcctcagactccactggggttgttacataacattcacaatatacgtatcatattacctccctaaaatctaataaaatacgaattacaaacacatttcgcccaaagggtttcagacaagggattaaggagctgtataaaatactagtagatcaaatctagcactatattaaaggaataaaaaccatagacaattaaagttaattacaacaatggtttaatatttagaaatttagtcatacaatttgtaaaaataataggtcaattgagtaaaaccacatgacaatctcaacattcgttcctgatataaaaataacctagaaatagcatgcgagttcctcaaaatgattaagaatatttatctgaaaaaacagtcatcatacttaataaaatttcaggagcattataattaaatcagaaaaaaggatatctgctatgattatttaacttcattctagaatttatagcacaagcaaagcaataaaaataaaagagctataagcatttaaaaagagaaaacagaagtatcattatgtgtagatgacattattgtctaccttcaaacccaagagcataactgaaaactgttggaaatgataaaagatttttagtataggagccagatataaaatatgtgcctaaaaccacatctatttatacgagcaatagccaattagaaaatataacggaaacatttaacccatatacaaaagaaatacagataaataaaaaataaacaagaaatatgcaagacctaaaaaaagaaaactcttaaactccactgaagggcataacacaagcgatttgagtaaatgccaggaggtatgttgtacttagataagagaaatcaacactgtgaaaatgcctgagatctctaacttaatctataaatccaacgcagagccaaccaaagttcaaacaagatttgaggggagcacctgacaaaattactctaaagtttttctgggagaataaaaatgcaaaaatgcctgggaaacttttgagattttagagtactggggaaataatcctctccaatatgaaaacatatcatagctacagtagtaaacaagatagcatcactgtatggatagacataaatgaaagctaattagaccccaaaatacatattattctggttgcatgtcctgtaagtagaaaacacatgaattattcagtaagaggtattaggacaactagctatcttcttgaaataaaatgataaaaaaaaaaccacaaaatctctatctcactccttacaccaaaataagggcctgatatggtaaagatttaaatttataaaaggaagagaggaaaggaagaagggagggaaggaaagaaaaccataaaagcaccagaaaaaaaagaaagtatattttatgagagtgaggaaggcctttctgatgatgccatgaagatgaaaaatcagtaacatactgataaatttcatcacataaaaatttaaaaacaaataaaaaacttattgtgaccaaaaataaaaacccaaaatcaagtaaaaagaaaaccaccacctgagaaaaaaactactgcaacataaatgataaagaaagaactaatagttctggtgtccaaagaccatttacaaataaaaaagaagaaaaccaggccgggtgcactggctcacacctgtaatcccagcacttcagtaggctaaggtgggcagatcacctgagctcaagagttctagaccagcctgggcagtatgacaaaaccctatctctacaaaaaacacaaaaattagccagctgcagtggcatgcgcctgtagacccagctactcaggaggctgaggcaggagaattgtttgagcctgggaggcagaggttgcaatgagccgagatagtaccgttgcactccagcctgggcaacagagcaagacctggtctcaaaaaaaaaggaataaagaagaagaaagaaggaagaaagagaagaagaaaaccacctaaaagaaaaatgtgcagagtataagcaactaaagcacaggaaggaaaatgaatgccaaacactaaataacacttgaaaatattttcttacctcactaataactgaatgctaatcaaaaaatgttttcatctatgcagtaagaagataaaaaagactgatgaaaaccagtgctgggaatggaagataaaaactacaactcttttagatagctgtttgtcaatatttagaattatgactatcaatcataaaatacctaaaagatatataactcacacagccaatatggttgccaacagagcagaactggggaggaaggacaaaattattcactatatatacttataaaacaataaatatttttaaaatacacgaaattataacagccaatacttactagctgcttggcatatgccagactccgtgttataaggcactttacctgcacatacccgcaccccctcacaacccattgttctactttccccagaatgacagagctccctcgctgtccttggtcctgaaagatgggaatacctgctaacacttcctcctcttgtcagaagaggaccaaagaggaagcgccggtttgtctcttctttccttgccaacccttccagaagaagcattgtgaataaaattgttgagagctagacctgcctgaggccatgtctgggtagccatggctgattttcctttgcttcaaaagctgtgtctccctgtgcccactcatgattcctgaggatacagtgggaattccctgcttcctgcttccactccattcctcattcaaagactgtctgttgggaaataattcgaacctggaacatttagcattcttttgcccagtgtttcccaaattgtggcaccccgaccagcagcatctgcatcacctgggagcgtgtgagaaatcaaattcttggatccaccccagacctactaaatcagaaactccatgcatagagcccagcaatctgtggtttaacaagccctgcatgtgattctaatatagctaaagtttgagaccgtctccaatcacttaccagtgaagaaaactaagactcggagagcttaaatgacttgcttcagacctgcagctagaatgtgccagggctgggatctgaactcagatctttctgtttggcaaaccatggtcatacacactgtgctatagtactttttaatgtattgcttgtgtggtataaattcagggaatacaaattttcttttaaaactacaaataatgttcttaaatgttgttataattagctttagcattggctttttaaaatttatgaaggtgacaacagagcagaaaattatgctaatcttatctcctttcatttaactccatctacatcacaggactcctgtgtgtggacaacagggacaagtccgccctgtctccccaaagccagcaacattgagttgtaggaaagtacctataagagccttgccagccttgggtgatggccataacgtgccacctacttcccttagatcatcgtacaagggctacctcttccaagaatcattttcggctggaaagtaaacctatccaacctatggtgagcaaatgtggtgtttactgtcatgccaaatattcttgttgtcatgccaacaagtgttggcaagctgcagtccacaggccaaatatggcccactagctttttttgtaaataaagttttattggaacatagctaagcttatttgtttatgtattatcaatggctgctttcatgctacactgggaaaattgagtacatgaggcagaaatatgtcccacaaggcctaaaatatttacaacctgtcactttacagataatgtttactgacccttggtctaaatggttgtcactcaaatcgaaagagaacagatttttgcatgcctgaactcaagttctaggactgacatgtaccagaatctgatgttcagaaagttctttaccctccctgagcctcaatttccccatttgtacaatagctgctccactgaactgtggtgatggttagatggaacaagacatgttaaaggcctggtgcacagcaggtgctcattacgggctattttcctcccttcacctacttaggtacagagattcctaaagaccagtggtgtcatagctccagcacatagtaggtacattgtttattcagggccaattccctttgtaaattcagaatgcagaggctctgcaaagcctgtaggctgcaatttaaaatgtctcatcgtccagtgatccaggcgataatttactaaccaggcagcacacttagacactatcatctcccaaagccaaacttgtcctgcccagagccaacagtcagctctggcttgaaaatgaaaaatgggctcctggggatagcagatcccggctgcaggagggaaagagaaaggggcaaaacggcaaaactctgttcccacagatctctgcctcaggaagagtccccccttggtgaccttagaatctttcacaagcagaggttttataactctcagctgcctcagaacagagagctcaatctgtctctcttcttggtcaagcacaagagcagccacacaaggaaagttgccttggacctgggtagtgagaagggcattcttccacccaccctcccacccgccatctctcctcccacccaccatctctcctcccacccaccatctctcctcccacctgccatctttccaatatttcctctatcccaagcgctaatggtttatgccactctctccttccaatttgagcttctggcatctcagatcatctcaactgtggttttgtgccacatctttgctattctcctcctattttgcctgtactccaaccatgttaccatccatatgtagaatcatcaattttcagtgccaagtatcctattgcccggtgtactgggcaatagcccatggtcacatgtggcccatctgaatcacagaaaggatacagacaacctgtaagcactggatgagataaacacattgtgcctctggcttccaggactctggtcttaatgaaaaggaagccttcttttgccaaagcgaggtgcaccagatgccaggaacctggtcccctgcaagttgaagtgctgattgcaaatacactgtatctggcaggggtgtgagaggctagcaaacgacgccctccctcagccctcagggaggcattgggaacatcctttgatgggttaattgtactgattaatttcagtacaaaaggtagaaaagtgaagagctccatatcctgagaaaaaaagaaagacaaaaagacaagagggtgaggaattagggcaagaaggaaagaaaaaaaaataagcaatagttagtattaacagattttattgtgtgctagatataagctaaataatttgtctgaattatcctgttcaatcctcataatctttgaggaagatttgaatgttgaccctgttttacaaatgaagaaatcaggtctcagagagcagaactcattttcctaaggttacacagcctacatgcagccaaccccgccttgagcctttctgcctctgagcttcacaatcctaacccgcttcattcctttgcacggaagtaggttaaagttcaaggacaggccaggaaacaggcacagagaccccaggccacagacttgcaaaattatccagtccagccttcctatttaacaaatgggtaaactgaggtctgaggcaagaatatgaccttttgagggtcacccagtgagtcatcagcctgaatactgtgaagaagatgattttttaataaagtgctttcacatcacaaggctgggaagtgggtaagaattctcagattcagcgcttctttctccttcctctgtctgcttatcccaccacagagaacagctgatatgcccaagtctggtctcttgtgatgctggcctaagggagtcccagggctcgttcaatggacagacacccaggagaagtgtctgcgagatggcatcattgtggttcaagtggtccaaggcagatggagcaggaccctggagagcagcaacaatccagccgccagcctgagaaaatgattaggctgaatttggagcacctgccagccttgggtcctggcaggagaccagaaaacaaatccaggaagcccagcagaagggcaaatccacaggtgggcaggggctgggagaagacagaaggcaagtctgaccagagggcagttgaccaggagtggccacctgcatacatggggcttagggcagcctggaaggctggtggtgatagtgtccgccagggagactggccagggaaggttacagtttccccctctccaggaagacttgcacagtggagagtgggctgcaaagctactaatcctttccaatgtgtcactcctgctgcgatcagtacattttaaggtcctcagaaacaaacttcataacgtactgaaaaggggactgaaagaggaacatttccctcttttcagaattgccaacacagatggcatggattcaagtccggcctcagcacctccctgccgcatgcccttgttactgaggcagccccttcaagcctgtgccactccacctgtaaaacggggacactgatagcacctacctcaaagcactgtcaggaggattaaatgcaccaaggtgtgtaagacgctcagcacagggttcttctcatcctaagtagtagacagccagtgtagtgcacggtgcagacaactcaataaaatattattgaacagattaaaactttcacacagaattcatttaacttgttaaagcaaggaagtgtgcagctgcagtgtaaaggctttttgcttttaactactcaaaatcaaattggtattccactctcctatccctgcactcaacgctaaggttatttggcaggtctggcatatgactacttaagatggggtaacagcctctaattaagccttaaaatgtcactgtaagacgggcaggcaggaaggaacatctcctcaggaaaacatttctgggccaggcttgggccaaagagctgtcaatcaagagattattatgtttcagagttttacacccaaacaaatgttgagatccaggagggaggatccttgaggataatttcttttagaaacagagcacccaagtccaaagggtagaggatttggcccagatcccctgagttagtagcattccttccataatacctcttctccctaaaattcctcccttcagttaatttcattagagctaactggtactgacacagcctccatgggcggatcagatacaataacccaatctttatttgtttattgagcaactactttgtgccaggcattggggcaaagcaccaagcaagacggacaagaactctaaactctaacttttttctttttctttttttcattttttttttttttttgagtcacagtctcgctctgtcacctaggctggagtccagcagtgttatctcagctcactcttatctcaacctcctgggctcaagtgatcctcctacctcagcctcccaagtagctaggactacaaggcatgcaccaccatgtccagctaatttttctattttttttttttttgtaaagacagggtctcactatgttgcccaggctggtctcaaactcccgggctcaatcaatcctcctgcctcagccccccaatgtgccagaattacaggtgtgagccaccacacctggacaatccctacccttttgagtttataatctcctgggagaagaaggacacgcataagaatacaaataatgattccaaacagcaattacagatgacaaaggtgaaaagggatgaaaggaggcaggggaaccgaatttagattccatagctaagaaatgtctactgagccaaaacttggaaactcacaaggactaagtcatgcagagttcaggaatgggcattccaaagagatggaagagtgaatgcaaaggccaagaaatgggctaacacaggggagggataagaggtgagtaggggtagaatcatgcagcatctcgcaggccacactaagattttattgcaagtgcaaaaggaagccagatgcagcagagagccatgagggtaacatgttctgtcttatgaattaagacaatcactgtagttggcaacgaaggcggccagcagtggtgggaactcagagagaggcactcagggacccagactaatgcagctgttacatcagtcccatccaaggcctaaaaaggctactgaggccaggcgcggtggctcgcacctgtaatcccagcactttgggaggctgaggcaggcggatcatgaggtcagatcgagaccatcctggctaacaccgtgaaaccctgtctctactaaaaatagaaaaaattagctgggtgtggtggagcgcgcctgtagtcccagctactaggggaggctgaggcaggagaatggcgtgaacccgggaggcggagcttgcagtgagcctgggtaacagagcgagtctctgtctcaaaaaaaaaaaaaatggttactgaaagcttccccgtgggctaagatggcttggacagcgggactgaggtcgggctgtggtgggggcatgcagttctccagtggcttcgcctcatctcaccaggaatctccctggacccaaggaaccagccatcccaacaccagcatcctgcacagttccgagactggccctagagacaccctgggtttcaatgaacacttgttcaactaaaatgaactcagtaggcaatccctcgagagatacaagctctgctattgatgaaggctcacagtgagacaaggataatgggttcaaatcttgttagcaaagtcagagaactgagaaatttctgagctccaaagaataatttcccttctgctttcaatatttttgcagggtgagaatctttcatagggcggccaggaataattcttcggcaattattcagcatctcttggactggttttgcttattttcatcaagttaaagatcattcacgccagtttcttttcaataccgccctcccttcccctccctcctccctcttcccctcagatctatgcctcataatctgttttccccgattcgccctctgcctttctcccccatcctcctccatgcctgatgcttctcatgtttcatctttcctgagaacccacagtgctgcgcttgagctcagcaactcccaacttttttatttgacgtcccagtgtgtctccagtcatctccaggggagttttgaaattcattttcattcactttaatttaaaaaagaaatataggccatttagttcttttaagagggggaaatggggtgtcactcaaccagcagggaggtgaatcctgacttcagctattagcttattgggcaaagtggctctcttccaagtgttcttggttcttgggtcgcttaagcaagtaaagtgttttgctaatgtctgagagacattcactcttggggggcaggaaaataaagttcagggagaaaagagacatgagaaaattaatgttttctattaactccatttccaataaagtaggaattcaacaaaataactcatatcactcatccatttagtcattatattcaacaacttatttagtatttaacattttccaggacctagtcatgctaatcatactaatgatgatgatgatgatgatgacaccgatgacaatgatgataacagcagctaacattttattcagcttactcactctgtgccaggtagagctctgcaataattacctcaattaatccccacagaactccataaaataggggttcttttgtccctactgcagaacagaggctgagaaaagttaaacaaattacccaaagtcacaccaatgtaagtggaatttgaactcaggactctctcatcaccaccatgacacactgcagccttgtctcagggttacaaaggcaaatgaggtacagccgtgcctcaaggatctcaccttagcagtgggcaaaacaggcaggtaatcaactgcatggatcatttggaaaagccatagaaaagaacatgggagtacaaaggtggggtctctgctcagcctggaagcagagaatgcataaagatccacttccagaaggaggtaaagaactcctgggagttggctgggcagagggggtggggtccaggagaaaagggcttccagagagatgaaaaagagaggaaggggtcgctcaggaggatggaccatgcctgagaaatgcagatatatggaagaggctggtgccaggggttggtggatagacagtccacgagccctggctggggagactgtcaggggtccagtggttattaagtccctttctggcaggctaactatgggtcctagggagccagggaagggggtgcacaacagggtggcacaaccagtcatggaatcttagacatggccccatggcaacccggatttggcaatatagagagaggttcagggggcccacctagaaagatgtttgatagacatctaagcaagcatgagcagatgtgggcttggccccaggcagtgggccaagggggtgggaaacagcagatatttgagagaggctaaggggagagaaatgatcgctgttggtggccctcatagagaagtctaagaatattggccattatttttctaaattctcctggggaaaaaatgtttctgcttttatttttctggcgatagtgaatttctaatgtatttttgccatctgctccacaacagagaggcaaataggattaacaaagtttatgacatggagagaagccctgtcctgtccttgggcctgtggggggagagaggtggctgaccaacagcagtcttcctgcaagtgaccctcacgaagacacctgctcgcctctgcccagccaccctccatcacaggtaacacatctgccctgctcttccccacaacacccttggcctgactcccaagagcagcaggggtgtcagatgaagcggtcaacacagataacctgacagctaaacaagagaacgaaatgaatattcagcagctggttctgcttcagaggctgttaccctgttctccatctctccttcaatcccaggaacagaagaaaagaacaccaatcacctctcagccccaccattctagatccaggtccatggtggtagagcagattgtggagattaacattcaaattcaaacagtcgcagcattctgtcagtgcttttaataagaaaaagtgtatatcctttggataaagcagacccaatttatatatctaatgtatgatctcttgaattcataaaaggccatgtaaaacatacatacatacatacatacatacatgcatacatacgtagacacacttactttgaaagctcaaaacacaaagccatctctctacttcaacatctgaaaaatactatcttgccaatgtatttcccaagaagaagacagtaaaaaggagtataaacaagaggaaaaaaagtataaaacctgattatcatcttcaatccaaacatctcagacacaggtagacccaaggctttggagaatccattccttgcatacaactcaattcctgctgagcctatgtgaccagacagacaagtgcagactggctttgtgtttaaaccctaaatgataccattaacatgaggctttcagttctcctgcccaagtatttcccggggaaatcactccgacaaataagctttcctgggggcaactggcatcctctttcagctctaaatatgctttagttaacagcatgaggcctgttcatccctgccctgctcatatatcctaaatgagataggagctagaagacctaggctcaaggacctgctgtgtcacaatttgactatagaaattagactaattatgggatctccctgagccagtggctatcagtaagaacaattgctaatatttcctgagctgctggggtactatcaactttatgttaagcattttacatggattatttcagccaatccttccagtgttttatggtgcccatttcaaagggaaggaagtggaggctgtcagtgggagtgctgggtggctgaccacaagcatcctcaacatggtctctgagctccagggcaccacacaggttaccaaggaagggaacatgcagcttgtagcaaggctggttcattcagcactcactatggtgcaggcactgcattgaccctgttggaaaacagggagagacaagagcatgggcactgcctggaaggagggctgtggcattgggacacacgactggtggtgatggtattgggctagttcacttggtttaggcagaatttcagctggacaagaagacgggaagggagctccagggagagggcactgcaaggacaaaggtctggccagcttagctactaaaggcccggattggtgctgagcaaggccacggccacccaggcagggcgttcacaggccatctaccaccagctctccctcatacggcgtctctgctcattgacagacccagccctgggccagtggctttctgctcataccacaaggtccaaatccgttacaggaaaccagtaatggcctaacctttgacactgggtaaacataagctctgatcctgggtctacctcttcacagatgaataattttgggcaggccacttcacttctctgagcctcatctgaaacatgggaatcatgtgactattataacccaaatgttggtgtgcatagcaaactttccattcacccctttcctgataacagaacctccctctctggtgggaaactcatcccatgggatacagatgggcctgatctctgtcctccattcccactggaaggagcacaggcctcaagcttgaccaatcaaagcatatcccatctcctgggtgcactgataggttctaagatgagaaagtgacccaacctccctcaatctgaatcctcccaaggcagttttttgaagctatcagaagaaagtggctctattctctggaatgacaaattgtacaagtgacacaaatctagagcatctgaatatatagaacattctagagaatgagctcaatagagagaaagcaaagtataatagaaccaagatatggagaggtggagagaggctgaaagcatgtttgcatgttctagcgaaagtctttgagttcttggatcaagctatacctgaaatctggaccactccttagacttcctacatatatgtgccaataatattgcccttcttttgctaactccagtttgaattgggtctcttgccacaaaggtcctgtctaaagcctggtaagtaagttagctacaaagattaaataagtcccagttaagtaaaactgaattgaatgcattctgtgcatttcaatcaatgctctttcccttcccttagttctaggtctcttgtcctaggcagatgtgaatctgtaataactacagaatatttgtagaaacttactgccataaaatgttcttaaacaaatctaaatcattcagttataagagtaagacacaaacatttggccaaatcatctatttaaaactctgctccaatccacccatttcaggaagctgccccagattttggtcacttatggtccttccagccacactctgtaactgtaaaaaaaaaaaaaaaaaaaaaaaatctacattattctatattattttataaatcaaattcctgtgtttcaaatgcaacttattgaaccgcagctgtatctctctaggaaaaaaatctcatcaaagacaatattttactcaaaaattcagcaagctttaaacaactaaaccgttaaaggaaaaaactatatagcgaggtagataagtaaaatcctatttcactaataacttttttcaccaaattgaaactatatgcctccaagggaaccaaaatgaaaacaattatcaaaaaaaattacttgaaaatgtagcaaattttaaaaagctaaacttttaaaggtaattttgattttatattttaaagaataaatgtgaatgaatgaaaaattcctggaactacttttgatacttgaactaatggtctcacggaaacaaaataataaaagatgagttggacacagcacatgtaatagaagaatcctgggctctcgtcatgggattcccaatgtccctgaagacagcccaggctttggcagcccagcttcccatactggcatgaggtaaaagcgattgcctttatagtggtagacttggcaggaaacacagcaacacaacaggggtaatgattcaaaattcagcataaatgaacaaagaaacatgtttactgaacccacctggctattgtgtaaaacaaaatatcacgtgctatctataataagccagttctctggactacaaaagcagttcacttactcaacagatgtttattggctatttggtgtgtgccatgtaccatgcaagggttgggaacacagcaaaaagctaggtgtggcccctgccctcagggagctttcaatcttgtttgtgcaacaaaaagtgtgcaaataattgcacaattctgaacttcaatgggtgtgtttacatttgaatctacaagtttattaatgctttgtgaaaaacttcatataggatgaggtcattctatttcccttttaaaaaaataggtttattaagatataattcagataccatatgattcaccagcttaaaatgtagaactcagtagtttctggcgtaatcacagatctatgcaaccattgccacagccaattatagagcattttcatcaccacaaaaagaaaccatatcctttactaagcatccttcaatctccccaaatgctcccagctttaagtaatcactaacacactttctatctccacagatttgtctcttctggcatttctttgctaagttcaacatagaattaccagataacctggcagttacattcttaggtatagaccccaaagatgtgaaaatgtaaagatgttcaaacaaaacactgtacctgaaacgttcatagcagcactgttcacaataggcaaaggtggatatggcatatccatatgatggaatatgcctcagacataaaaaaaaaaaggagtgaagtactaacacaggctacaacacgggtgagccttgaaaatatgctaattgaaagaaactagccccaaaacacgtatgacttaattccatttatatgtattcccttggcctgaaagttctcttcttgtgttccttctctctcttccccatcactcacccatcctctgtgatctcacatccaccccctccactctgtccccagatccactgttctggatgccagcatcagtgctcatatctggatcatggcggctgactcctctttggtcccttgcccctgggctttcccctccaacctaccccatgcaccagctacccgggtggtttctctaaacacaaatctggcagagctgattacaacccatgagtggcagctccatccaccatcatccactgaattaaagcaatccccatcacacacaaactcccaggtaccagcacccatcattcatataacagacatggagccatccagcatgatgaagttccctggatcctgcactcttcactacccacttctgttcctgcctctgtttgtgctccgcctggattcctgcctttgtctttcctacctagaaatactgctctgtcttccagacagttcactccttctccaatactgagctggccaccaccctggcgattgctctccacagtgtttgaggactgtttaattaactactgctaaaaaccaggagctgtatctgctcaccgctataaccccatgaactagcaccaagcctgccttgcacattttcccaatgaaaatgagggagaaaggaacagaagaaatggaggaagaagttaatacatatttctaagaaattaatacatatttctcaataacttaggcacctatttatcaaccaacaaataactattgtctcagatattgaaaacatcttggcctccttaagctttttttcctcagactcgcctagtctcataagggacaaaatcaaactccagagttgaaaacaatagcaacaatagagaaaccacaagaagcctcagctcaagtcccaaaccagggtaagaataggaagtcctgccttcctggagtcttgttcattttagaagcttcacctccaatctacttgagaaacaaaatagggactggtagagaagagttaatagaagcatcaaaatggagacattacaaaggttttaggaccttgatcttaaaaccttggttcccagccaggcacaatggctcacacctgtaatcccagcactttcggaggctgaggtgggcagatggcttgaatccaggagttcaagaccagcctgggcaacacggcgaaacttcgtctctacaaaaaatacaaaaattagccaggcatggtggcatctgcatatagtcccaggtacttgggaggctgaggttggaggatggtttgagcccagaacgtcaaggcggcagtgggccaagattgtaccactatacttcagtctgtacaacagagtgaaaccctgtctccaaaaaaagaaggggaaaaaaaaaaaaaaaaacaaccttggtccctgatctctacctcccaaatctgagcttttaggctttttccttcatttctattttctggaatcctgaacacactgatcttttctttctgatctcttgtttggagaagctcttgtggactctgtagtccctgacagcacctcttttcaggtaagacacataaaggcaaaatcatagataatccatttgcctccagtgggggtggggggagcagcaaagacagcaggaaggtttacagatttttctaaagacccatctagttctaactctctatgatacttggtagaggacaaaatagcatgaaataatagcaatatgcgtgagcccaatcaaagaatttattttcaaagataaaaatgcaaaggtgttgttcatgatgattgaaagcaaaaaataataaatagtgacatttgagattggtcttgatcactcctgatttctaaaatctccccatcaccctaccattacaatttcccactaattactacaagcaattttattaatatacttttcagcctcattaaatattaccttgggcctaacattaaaaatgatgaggctcagtaatcttaatgagcatccaagttgcaccgacccctgaaaacccagaaaacagagaactaaattcattgctgaactactctggtccccaggcatgcaggaatcaacttcagaaacatgaaagaaatgatacgtacaacccagaatgaagcctgattggaagcacataagtttagcttggcctccttcagttcctgtcaactaagggggcaggaaaacgtcgaggaaacatctgggctttatcttctcctcccctttcaccctggttataaacagcatccatcagcatgctgttcaccaatattaagtctttcctgggactctgacaggtagagcttctagtgattgtgggctgggccaagacaaagcaaactggaaatgaggtatccactgctctagcaaacagaaatctgtggctttctctgaaacggtagtggaagcacaaagaatagacagttgagggaattaggaagataaattttatttgttttcttcctagcatgaccagaattgtctgcattcctcaaacagcaagctaggcaagacagtgagaccagcttcctggttctcaaagtaaattatttatcaggagctgaatttactgctttcctgactaaactgtcaaaaccctgccatttacaatagcagttgtactgtgtgatccccaagatgcttaggtttcccctagcttctaggttaaaaatgaatgggtaacagtaaaccaggggatcagctgaagagaccagcccagacttactgaatccacctttggccaagatctgagagagttctccatgtgtccgaaaccagtaaacttagcacaatgtaaaactattatattagacagaaatctttggaattatctaatttaaaccactaattacctaaaagaaaactgaagtccacagagaggaaatgatttgtcttggatgaacaagaagagtcaaatccaaaacctgaactcttgggtcccattcattatactaccatggatattgtcaacctgaaatgggggctgtaatgggaatggaggcagagacaaccatccaccaaagaattgtggtgtccctctttcatggcacagtgctggctctgggacgtggctacctaccaggaactacatcttcgcatccttccacccactctcatcccactaccttgcagctgagtccagccacaggaatgcatcctagccaatgaaatgggtatgaaagtgctgtatgatgccacttctgggcgtgacccatgcaaacctcaaatccagagcttctccttgccttgccctatctaatggctgggtacagggaagtttaagatcataggagatagtgaacctagatcttcaaatcacctgagggaacaaagtcttttaagatgaggcatacacacacggtctgttgctgaagcaagatataaaattttattgcgtgaatctattaaaatttttctgggggggtgttattcattacagcacctgctattaacctaacaaataccaggaacaactttatagtggaaaagatctcagacacattgagcccaaagcaaaactgaaagcccataaaaagaaccttgttataacagtgggaaaacattaacaaatcaaataataaaaatgataatttatcaatttgccaacttgctcagcagactcaaacggattaattgttccaggtttctgagggggaacaaaacccaagtaaaggctagtcttgaaaacaaagtatttttgcaaaggaaatttttcctcaagcgtccttattcctgcttccttttatcttaaaagtgatggcaaatgaactatcgatgcatgcaacaaccttgatgaatctccagggcattgtgctgagggaaaaaaggccaatctcaagggcctttctactgtctgattctacttatataacattcttgacatgacaaaattgtagtgatagaaaacagatcagtagttgccaggggcttgggtggggaagagtgtgtctcttaaacagtaacacaggagagtttctttgtggtcatgggtcagttctgcctcctgactgtggggatagtcacttgaatctacacacatgatgaaagttcatgggggttgggagggtggggaatgaaggaaggaggaagggggggaaggggaggggaggggggaaggaatggaggaggaggggggaaggggagaaggaggggaggggagaaaggaaggaagggcagggaggtagggaaggaagggaaggaaaggaggaaaagaaggaaggagggaaggaggggaggggaagagaggggaggaaggaaaaggagggttgaaaggaaaggaaaaaggaaaagggaatgaaagggaagaaaaaaactaaaaaagaaagtgcatgtgaaaactagtgaagtccaaataaggtagatctctaagttaacaatttcctggttttgacaatattactatgattatgtaaaatattacctttagagaaagctgggtgaatggtacaaggaactctgtactatgtttgcaacttcttgtacatctgaaagtatttcaaaataaaaacttagaattctttaaagtgatggcaaaggccctggaccaccaggttctgagttgggaaatatgccttgtacttccagattgggcaacatgaatatgataactgcagagagttcaggggctactcacaggacctttgccattagtcacatgattatttgtttattctttgtcttccttctagactataaatgcctggaggtcaggagccaagtcagttttgttcccccactcaatgcctaacccagtgcttagtacatagaaagcacccagtatatatgtgtgagatgaacaaaaaaacaagaaggggaacaggcaaggaaggaagtatcactcacgctttacagaggcagtggtgtgcagaggtttccatgccttgcccttgtgcacacagctggagagaagcaggacaggtacaaaaaccatcagggcttccagagtgcccagtgaccttttcttagtgccatatgcctctcaacttagatccctggtagttgctttatcttacataataaaaaaagtaagaggggaggaaaaaaagagcagacacagagagagaaatgagacagagagacaaagagatatgaggaaagtagtgagagagatcgggtgaaagagggcaagaaagagggaggaagagaaagtgagtggggagagagaacaatgaagagagagagggaaggagagaagagagaaagagagccagagaaagaaagaaggagagaggaagagagagagagaaaagaggatggaaggaaaggagagagggaaggcaagagaaaatctgccccaacatggaaaatgacattgaacaaatggattccaaattttaacacggccccacaccataggcccaggcctctgtaactgctctaattgctcagaaatggtattgtaatgtgaacaatatgtcattaagcaataaacgcttcatgcaaaataacaaagtggtcatcagtgagatggaaaccaggaataaccaagggaaattgtgctccacatctctccatgctccaattatcagactgatcagtggctccttttgtctgttcagaaggtgctgcagttttcagtacaacataatataatgtgaaatgcaatacaccaagactaagaaaaccttatttttttttcagtcttacagagagagcaacagattcaaatttgaattcaggctctgctatcttctttgcagccactgcggcccaagctgcactggggcccactggagaccacctcgggtgaccaatgagtatagcatcagagtgtggggagcagagtcttcaatgtgaggtggcgccaggtagggcatgtcaaggtcctgcagccactgggagctcttcctttgaaaccagtctgcaccctgcacctagcccttgcactctgagcctatgatggcaggggcaggtctgacgatctcagaatcaactttagggtcattcttccactgtcttggagaatagctcctggcttccgttaagactgctgattcatactaatctccttatcaaacagttgcttggacatagccttaatgttctttttttcaatatgtataggctgagaatttttcaaatctctaagttttgattcctttttgcttaacaatttcatttttgagtcatttctctcttccttgcattttactctgagcagtgaggaggagccaaggcataccttcaacattttgcttagaaagagcttcagctaaatatccaattttatcattcacaagttttaccttccacaaaacactagaacatgaagacaattcattcagctaaaagctttgccgcttgataagagattgtcttttctccattgcccaataacgtggctctcatctccaactgagacctcagcagaatggcctttaccatccgtatttctaccaacattctactcagcattacttaggtattctctcaggaggtggaggctttctcttgagctttcttcctcttctgagccctcaccagaatcacctttaaaggtctgttcaacagccaggcccagtgactcatgcctgtaatcccagcattttgggagactgaggtgggcagatcaactgatgtcaggagttcaagaccagcctggccaacatggtgaaaccctgcctctactaaaaatacaaaaattacctgggcatggtggtacacgtctataatcccagctactcaggaggctgagtcatgagaactgcttgaacccaggagggggaagttgcagtgagctgagattgtgccattgtactccagcctgggagtgcaatgtattctgagacagagtgagactttgtctaaaaaaaaaaaaatacattattttatttttgttattattatgtctgttcaaggcagtgtaggctttttctagcacgtacctcaaaactcttccagcctcattatccagttccaaagcctgttccacattttcaggtgtttggcacaggagcacccccatttctcggtaccaatttttatcttagtccatttgagctgctgtgacagaacaccatagactaagtgacttatcaacaacataaatttatttctcactgttctggagcctgggaagtccaaattcaaggctacaagaagttctgtgtctggtgaggacctgcgtcctggaacatggatggtcttcctcttgctgtttcctcacatggtgtgagggacaagggggctttctgaagtcccttttataagagcactgatttataagagctttctttcctggcctaatcatctcccaaaggccccacctccaagtaacacacatcaggggttagatgtcaataaacaaattgtatgggaacataaacattcagtctatagcagtcacttttcatctatgtgactatgagcaagttaatatttttaattcggctttattatctgcaatacaggcacaacaatacatactttgcatggttattgtgaagattgaatgaaataatttatacaaatgtggctactagcacagtgcccaccatgcatttagcactaaacaaggacctctgtgttctcttccagagagctcttcatccagaagctcaacacaaaatgttgcacactgtaggaccattcatatgacgttctacaatcaataaaatgtgcctagtaagaattagacttgtttgggaggaggagaactaaagggcacaagggtactttctggggtgacaggttgtgtattttggtaagattataggtgttacaggagtgcatgcattagccaaaactttctaacccatatatttaagatctacatactttacagtatttaaattatacctcaataaaaaatttaaaatagatagctagatatctagatagccagatctgtaggtaggtgggtaagtaggagggtgggtgagtggatgggcggataaatgaatggatggatggatggatggatggatggatggatggtcagtcagggtacctacttcagcatgaggctcacaataagcattccacaagtatttctgaagttccagaatcaaaattaattcctcttaactcctttccgtcactactctcgctcctccagaaacaatctactcaactgtagggtggcacagccagttctaaaagtgcttccttctatgtgcctgaatcctggtccctgatactccgactcaagaggccaggtggatgacatctgcccactgcctccttataacagaactcaacggtcttgagtatcaaatgtgctcggcctcatgttgagcacctttaagtccttcactgtactagtcaccttcaattcttcaaaatctccttggaccgtgagcccagatgggcctctagatgtcatcttttaagtatgtgtcctcaacgaatgggctctgggcagctctactgctatgaagtggtgtccaccatctggagctcatgcctgtggtttggtgcatagtaattgccaatatctactgagcacttactccatgtctagcactgttctagatacaacatgttttcactcctttagcctccacaataaatcaaagaagtctatgtccttcccattttacagatctgatccaacagaatttcaaggtaactctttatctcagggtcttttcagaccccattaaatcccatctgcaaatctcatctccacacctttatcccacccatcgttataatcgaattgctgtgactcaggcagaacaactcttgcctaacatacaaagcaggagttcaatttaaaacatgacagtggagttttgaaggaacaattgactgatacaacaatgggtgaagcttaaaaacattacgctgagcaaaagcagatgaacacaaaacagtacatactgcatgtttccatttctagaaaagatcaatctaatctatagtgaccaaaatcaggtcactggttgcctggggcttagggtggaaggaaggactgcaaagaggaaggagagccatttctaggtaatgaaaatgttctatgccttgatcagggtggtgattagctgggtatgcacattggtcaaaaccaaaactctgcacttaaaatgtgtacattttattggatgtgactaaagctgatatgtttatgcaaaaacaaagaaaagccttctgagccaacagctctagctttcaatctcgctttgtcttttcctggctgggtaacctagggcaagccacttaacagatctgagccttagtttcaggctgttgtcagggttggagataatacatgccaaacacctgggggaaaaccaggctttcaataaatcgcagcttctgttattactgttaattaataataatgagaaataataatctgagtaacagcttcaattctctacttcacttcgctgggagatcttgaactgctaaatgttccttactattagctctccctgaaaaccaacacacactcttttgcagcatgcaatcacgttaacgctatgctagaagaataatcaagaatgaataccaaatgtatgtagatgaaagaattcatgtttatatatgaatatgggccatgaaatcttggattaattcaaacctgaacatggttgacagttactattttctttccaaggaatcagattttctgcctaggtaactccatgggagttttctactatattgttacacagggtgtaatttctctaataaggtcattgaggggaaaagaatcctggactctctaatccctttgtattactttttcctaagagtgtctttctcaagggatatgacatggggtcagcatggcaaatttcaaatgtatagcaatctggtttgggtcgttttcaagctaaaatctgtgagctcatctctttgttttttggtcacttacctccacactcagaaaattgctttgtggaaaactgttcagctctatttaggcttataaataatttatccaaagctcaagcaaaggtgaattagaaattttcagggttcttggtggaactaagactcagtgtgaggtcacaaaagattaaacaataatggcaaatcgtatgtgaaaatgaatgaaagggactaggtagaagtggcctcaaagttgcaaacatgttagtcaacccatctttcagtaaattcctccaaccatccttcatttggggaacatccttgttccactgttagtcatccaaagagccaacttcgggatgtgagggcaatctggctgcgacatctgtcatcccattgattgccaggattgattcagctgatctggctggctaggtgggtgtccccttcctccatcaccactccatgtgatgtgcgtccctcctgaagctgcgcagtgggtcaaagaggatgaccatccccgagagagtaggaccagtcttcagtaaagggtataccaatatctgcgctcccctgatagaacctccaaacaaagagccaacttctcctgctaaatgccatgctggtggcattccagtgtgctctcggtcttagcacagatcaactcagtgtcatgagtcatctcccttttggaagaaattcctaaatgttctggcttcatagtgagtgctggagaattgagagccttctaaagacttaaggaagctccaaagaaaagaggaaacagtcattgcctagacaggaaccactgaaatacagctcctcaacccaaaaagcagctctgcaagttcccaggtgttaggctccattctgagttcacatgaaaccaagttcatcagttgatggactcaacatgagttcagaggtctcagagagtaaaaactagcttccagtcctacttggactcctcaggaaataaaatttgctaatagcatggtacgtttatgatttgactttccttatatttacccgtggactttccatgagacccaaacaacttttcttaaaaaaaaaaaagttcccttctatggcacagactactacctattcatcctacccaatttcctcttcttcttgggaacagagtgagaccacatttcccaggatcccttgcagttaattcctaaatttacaactgaattctagcagatgaaaggtagactttatatgataatggcaattcttaggcctggtccatgaaaacctcctaccccatcctccaccctctagtttcccatcaccagttgaatttcacagacctataggaagacagagccacaagatgggaaatctttagtcctgaatgactgaagagtatagtcctctgccagtcacactggagtgatggagaaaacaaatctttattatattaagacaatgaaatgttgaggttgttataagagttagcctgtcttgactcgcataccctcctctatggtcatcctctcaaaaactccattaaatgatttcaaattaaaaaacaacaacaaaagaacgttaacacctagcttatgcaagacaaatacttttagatcaaatctcacaagtcagcctgactgcttcagtcacagctgcttcaagttgtgaactgcctgtgggtgtcctcatcccctcctctcaacaaacatcaagttcaaagaagtcttctggaagtcaagagctgacaggagctggctgatgtcaaggaggaagcccacatgtctcaagccacctctggtaacacttcaattatccaccacctgcttatcatgaggttctgagtacagctttttccactgtctcccaaagaaaaggttaatggaaagtgtcaagatccaacaggccgataaatcccaacccttggttgagaaaacagagcttatttctagacttagtcatgattctggatgctagcttatattaccctgacccctcctgtctttacatttgccctttcctctgttgtggacatggcttgccctcatcggtgatgatgatccttctatccatggtcaaaacttcctctcttccaacccacactcttaaagggtcatgctctaaactgaaggaaactccaaaagaagaaaccatctccttcccctttgcatctcctgccccaagcacacaagaggtgcactcatcagcacaggataactgctacagcaaaaatcttgatattttggtggcttaaaacaatgaacgttttctctgcgttcatgccacagtccaatatagattcacagatctaggatcctataattccaccaaactctgtggcatcagagtcttccgtagtcaagggaggagaatgcaaatcacatgtagtaaggatttacaagagccaggcctgaaagtggtatttgtacataactttcactcacatttcactggccagaactcaaaataggcccatacctaatgacaaaagggcctagtaaagtattctcactagagcttaaaaggaaagaggaaatggattttggtgacctctccactgtatgtgacccagtgggggagggagtgtctcacagaaggcagttagccagcttgtaaggacatgacccagagatctgttggtaggaaaatgaaatttcccagaactatgcaaaggagatctgctaccttagcacaatgaatcagatgatgtacaccagccagaggttcaggtaaggtgggacctcacatgaggtgagagcaagttatctgaaaggagaggctcacatgtacatgaaagagaccaggaaaggtctaagagggaagacaaggtgatgttgcctcatagattcacgctggttgaaccaggctgacttctggtttcctacagagtcaaagagctcagagtaggcagacctctcattttacagttggggaaaaaaaggtgtccatagagttaaagcaatttgcaagttgcacatctagcaagcaagagaaccaggactggaactcctgtccctgactctatcactcccagtccaccttgtcagctctgtatatacccctatatctgcaaaagtctaggccttaaaaaaaatagctaccagccagtttattctctcagacaaaagatttccagaaaccatgtcttccaccctggtattttgctcttcccaactctctctctctctccttccaaatttacataaactatacacgtggcaggtgcctgtatgaggtacaaggacaaaggctctcacacacccaccagtctgtgtcacccagatggcttcctgctcatgcaagaaggacttggctcggttttcatccataaatgtgtcttcatttgtccccggaggcctttctgtcacctacgggagcacttctctgcaagctctgtgaattataatcttctagagggtatgttccagacaatgaacttctttccttccgtcttttaaaatgagattaacccaagaacattgcagaggctcccagtgataagcatttctcagactccctaacactggtgcaggaataagtcggtatgcttttctgaatctgagaaagcctagaaacccaggcctcatctgaagaagtacgagagacaaacagttatttctggctacattcctgtgtattccaaccgaattgcacttccccccatccacccattctcccttgttctccacacctacctcaccttaggtcacctctaccctgttccaacctgaactgtggggcatagcacggagtggtggaagggtagggaaggtggcaccatcaaggcaaactctgaattcctgggagagtggcttcatctttgttctacagcagggctcagcaaacttgatgggtcaaatctaacccaccctctcttttcgtaaatgaggttttgttggaacacagcccacagccaagctcagttgttcacatattttctctggcactttttgtgctacaatggcagagttgattaattatgacagagaccctgtggcccacaaagcctaaaatatttgctctctggccctttatagaaatgtttgctgagccctgttctgcaggaataaagaaccagttttctttcaaacaaatattcatagcagcattatttgctatagccaaaaggtggaaacagcccaaatgtgggtcaatgggtgaatgaattgtggcatagccatatgaaatattcttctgccataaaaaggaagtaccgacacatgctacagtatggatgagccttgaaaattatgctaagtgagagaagccagacacacaaaaatcacattttgtataatttaatgtatatgaaatatccagaataggtaaatccatagagacagaacgcagacgggtggttgccagggaatggggagtgggggttggagagtgactgtttaatgggtacaggatttccttttagggtaataaaaggttttggaactgtatcaaggtggtacttatagaacattgtgaatgcaccaaatgccactaaattgctcactttaagatggttattttatattatgtgaatttaacctcaatacattttttaactcaaaaaatatgtaattttttaaaagaaaggagtcagtccctggagattttggagcagaggagtgatatgatctgagatgtactttcaggcaagaaccaagtaatgcttacaggaagggaagtcctcggatgactgttgggtacctgagaagagggtggcaacaaattagaaacaaagggcaaggcacagtggctcacatctgcaatcccagcactttgggaggccaagacaggaggatcacttgagcccaggagttcaagaccagcctgggcaacagagggaaacccccatctctacataaaactttttaaaaaatagctgggtatggtggcacccacctgtagacccagctactcaagaggctgaggcaagaggaatacttgtgtcaggatttcaatgctgcagtgagctataatcatgccactgcattccagcctgggtgatgaggggaggggaggggaagggagaggaagggagggaaggaagggaggggaggaaggaaggggagggaggggaggaaggaagaggaggaagggaggggaggaagggaggggaggaagggaggggaggaaggaaggggagggaggggaggaaggaaggggagggagggaaggaaagaagggaggaagggagggaggaaggaagagagaaaaggaaggaaggagggagggaaggaaggagaggaggagagggggagattgatttttaaaacgaattaggggccaggcgcagtggctcatgcctgtaatcccagcactttgggaggccgaggcaggcggatcacgaggtcaggagatcgagactatcctggctaacacggtgaaaccccttatctactaaaaacactaaaaaattagccgggcatggtggcggggaacctgtagtcccagctactcaggaggctgaggcagaagaatggcgtgaacccgggaggcggaggttgcagtagccgagaccgcgccactgcactccagcctgggcaacagagagagactctgtctcaaaaaaaaaaaaaaaaaaaagccaattagggaaggggagctcagtttgggacacactgagtttgtatacctgtgggacaactgggggtataacaacagggagttatcagtgtgggactgagatttaagagcaagatcaaggacagagctagtgatgcaggaatcatacttagggaggcagtattgccatgagagaagaaaggagaaagaattggacatgttagaaaatcccaataactacagggcagtcggataaagcacagcctgaagtaatatcaaagaaggtataagaagagggtcagaaggaagccaggtgaaaagatagccatggaaagggtacagtcagtggcaccaaatgctccaaaagcatggaggaggagacagaggaagaaaacctgatgaaaggtcactggagttgcagggtagcagtagagctcaaaacctactacctggttctcatcttttcttctgagcagcttaggttgctggataagtgaggtcatgaataatgaggtcatgcatgcagataaatgcatgcagtctagaacccaaaggaagtgagattccaaagatgtgagctctgctctcctctgaccctcagccccaagcttggaaggacagcacagacagcatccaatacatgtttgatcccagccatggccctaggtccaaaggctgagctcccttcccaaaattcagataggatgtctctaacactagcacacccagcatatgcttgggtccctcggttaacgcgcgcatccagctgggacacttcgtagccatgccttgatgttactactactcaaggtcttccaacaccagcagctactaactggtcagtgctataaccatctccatctgcaataacaaatcttctacaatgttacattaacatcaaaatgatgacattcagagtataacagcaaattaattccttagaaacagaatgaatccaacttgccattattaccttaagtgggaatccaaaaaggctgtaataaataatataaacccattatatttattcatccctgatctatcctttataatattaaaccaaagaggtaagcaccatggaggagaaatcattatttctggtatgacaaggaagagactttgctggggaggggggcgttgcttgacaagaagcggtgaggtatcttttagcaaaggcaagtttataatgaggactgagtcggcttttttatataagagcaattcagctgtgaaatgggcttccccagaaatgaggtgggagtccctcagcttcttgggagccgtactaatgggttagtcatgtatgacagcttgcatagtggttactccagttgagaaggctttggacagccttcctgtgatttatacaatatcaattggaaaagcatcctattttgccaggaaagatgtcctggaaaaccaagcccacgggctcctataaggcaggtgcttcaagctaacttcaggtgataaatccaccagccccctaatatgcccttttagaaaacgcttttgcccaaaagtcacagacaggcagcctatgagccaaatctgacctacagatgtatttcaatggcccagaatacttcctttgtgggttatttttttttaaacatctgaatctgctcccaactctccaaactttcaagatgcagtgcatgctgctggtgcacagtccggatagtcttgaccagcaggtgaccagccccagatgctgtgggctcacagcttcctccttctccaaagaaatgcaaatcaaaaccacaatgagataccatctcacaccaattagaatggcgatcattaaaaagtcaggaaacaacaggtgctggagaggatgtggagaaacaggaacacttttacactgttggtgggactgtaaactagttcaaccattgtggaagacactgtggtgattcctcagggatctagaactagaaataccatttgacccagccatcccattattgagtatatacccaaaggattacaaatcatgctgctataaaaacacatgcacatgtatgtttattgtggcactattcacaatagcaaagacttggaaccaatccaaatgtccatcaatgatagactggattaagaaaatgtggcacatatacaccatggaatactatgcagccataaaagaggatgagttcatgtcctttgtagggacatggatgaagctggaaaccatcattctcggcaaactctcgcaaggataaaaaaccaaacactgcatgttctcactcataggtgggaattgaacaatgaaaacacttggactcaggaaggggaacatcacacactggggcctgttgtggggtggggggaaggaaagcattaggagatacacctaatgtaaatgacgagttaatgggtgcagcacaccaacatggcacatgtatacatatgtaacaaacctgcacattgtgcacatgtaccctagaacttaaagtataattaaaaaaaaaaaaaaaaaaagaactgccctcaaccaaaccagggccacttacctctaccacagagcagtggccaatgactgaccaacacaagggtatggtgatgacaaaggcaaggcaaggagggaccaaatctggtgcagtttgcagtccggggttccttgaggcatcaggctgaagctggacaccagccaaggccacatccttgcggagctcctatccctggctgtcttgcctccttctctactttctccttagagcagggttctcaaaatgtcgtccctacactaacaacattagtatcacctggggctcgttagatatgcaaatctcaagccccactccaggctttctggattggaaactctggggatggggcccagccatttgtggttgaacaagctctccaggtgcttctcatggatgctcgagtttgagaactgcagcctcagagtgcagcctcaattaaactgcatttacatgggcccccagctccagttctgcttcagggaacccagttcaagacaggaaagttcaggccaggcgcggtggctcatgcctgtaatcccagcactttgagggggccgatgcaggtggatgacatgaggttgggagttcgagaccggcctgaccaacatggagaaaccccgtctctactaaaaatacaaaattagctgggcgtggtggcacatgcctgtaatcccagctactcgggaggctgagtcaggagaatcgcttgaacccaggaggtggagattgcagtgagccaagatcgtgccattgcactccagcctgggcaacaagagcaaaactccatctcaaataaaacaaacaaaagacaggaaagttcacattttcaaaagaatctgctctgtccagcacctcttgaaaacggcttctttcccacagggaggcaatgcacttggcctggaagagctgctgccccacttaaacagtcagtcaccattgttttccattggtttgcacccagcctatctcaggcatactgcctggtctatgtgggccattctagacatatgatctagctctctagactgtgagcctcttgaaatcagcacttgcctttctcatatttgtatcctcacagcctggcacatggcactcatcaatgtctaccgagtcaaaccaaactgcaccaaccctgtctcttgaaagtggccaacacttctgagactcgaaggcaaaattaatgcaattaagaagccaagaaacaatccctgcaacaaattaatataatggccttatagacatcatagtcatgcattggctataatagtgcaaagatgtaatatgcaagagaaattggttgctggttcacctgatagccatcctaaggcctgaagcctgcagattaataacccttgtaattttatcccagtccatgtaattgcaagtgccatctttacttatttaacatctaattcctcaaagtaggtttgcaggcctctaacacttggttcaaatattctcattgtcttcttagctcagagagacattctttattaaagaatcaagctgaatgtgaaataaacacaaaataaaatctggctgcaaaccttagctctggaaaaaagaaaaaaaaactcatttccaacccagtgctagctgcttgcaaattacccatgtagaaaattgcccaaacttttctacccaaactgcatttgtttctgattttaaactaagttccgttcctaatttttcttcctttctccaaagcttctatctttagaaaatatggagcccaagttctataatttgcacttcatttgaacactaatgaaaagaaatgctcttccccttcaaactatttcctcagtcaattaaacaaatcctctaagtggagtgtgtgaagtgatttgtgtccaagaacttaattagtacttaattctggaatttgtatcttcttaagctcacatccttttaagtttccaccaagctcaaaaactggtccaggtgtggtcctttaccataagatcaaggcagaagctgatttgaagaagtcaggaggaataaaagaccatctgtgtgctcaaaaagacttccaagcagccttatggccaccaactaaagtcccttgcaagtccacaaaagagacagggtcaaagaggacttgcttacactgcaaaatactagctctcttatcataaggggaccacacgctcatgaaggaaaaaatacaaaataatataaaggagaaaatgcaatcagctacctagagatagactctcttcctccatgttttaactgttaaatatacaatggatgtattacattgtagatcacattctgtgtatgtgtacatgttttcccatattttcaaaactgtttccatacgtctgtctcttatttcaatgtgctccgttatcttggtaaatttgcctttcagacccttctgggctgttactctaatcatgcatcctcaaatctttagggggaaatgagtggcaaaatatagcttactctttatgtagaaagcacaggaatatatatatatacacacacacacacgtgtgctatacacacgtgtgtatatatatacataggtgtgtatatagcacatgtgttttttatatatataaatatattaggttggtgcaaaagtaattgctgtttttgccattactttcaatggtaaaaaccacaattacttttgcaccaaccttatagatacatattacatatttaattaccactttattcaaaggtgtctccttggaaatcctggctaccctctaggttacaattgtttggctggtgggaagggagagatacatgatccaagcagagccagggtctcactctgttgcctacgctggagtgcatggcacaattacagctcactgtaatcttgaactcctgggctgaagagatcctcccacctcagcctcccagtagctaaaactataggcatatgtcaccaggcccagctaattttttaaaattattttgtagagacagggtctcactatgttacccaggctggtctcgaactcctgggctcaagggatcctctcacatcaatctcccaaagtgctgggattacaactgtgagccaccatgcctggcccacctgtgctttatatacaaacatatagtatctctgtggtattaaataaatgttatgggccgagtggcaattaggaggaaaaaatgtctaaaagacttcttaagggggatgtaatgaaaaaaggttgaaaaactgtgcagtagatgactataatataattgacttaaccaattcttttaataaaatctgccgacacacacttattacttgatgtcagacttaaaagcaaaaacaaaattttataacgtctattaatgatcatacgttctttttcagtgtaaaaagatcagtttccctaatgtctggatctccaacaatctcagcattccatttcattaaaatgaaactgatctacttgttggcaatctgtactgggctcccaagcttccatatgtccatcatttaattcgactctgcaggatggaaagtaacattgaataagtcctcatgtaatccttggcacacaccatgaagtttgctcgtgcatttattcaaacatttatttaggttctgagaagttatgtgacttgctcagagtcacacatttattcagtggcagagcctaaatttggtcctaatgtcagtctgctttccacactcccacagaaccttaatgaagtcactcttggaactttctagtacttagtttctctatctgtaaaaagagagagttgaactagatttctaattgggtcttgccatttcaagagttcatttaatcgagtagctagatgtttaggttcatgggtcaaacaccacaatgttaagaccactagaaaatggaaggatatcgatcttccttttactcctccaacattttggaagaaatatatccgcactcttgagattctgcccacagagccaaagctttccagaaagaatgtgctgatgtgcttacttcaactgcgaaagcacacatctcattctgccccttcccagagcttttgcataggctcattccccggacagagcctctggggagatctctgcatggatgcagaacataaacatccagcccttcatgaacagtgttttgtttttctccaggccatcgtcctgctttccggcactaaacagcagagatgtatctgcatcaaaagactactgtctaattaaaagaaagttttaagaactatgagtcctggtgggatttctcacgaaagtgttgagcatccccaagctgaaagaacacactgagtttagaaggtagcgttgcatggcagcgtttcaagtgcatatggcctgttttatctttctccatctacctggcacggtgaagagtcctctcctgcggagatgcacacccagccgtcgagagctccgcagagcgctggaatgaggcatgcgctggcacgcgctggatggcagttgcttttcttctactgtgattcattatgcagccaggctatgctctaataagcactcgtcaggttccatcccacaggttgttgttgcatctcgaggatggagctgggattcctgcacatatgggccccagcagcatcccaagtgaaatgtgttacccaactagacatcattctcatttaacatgaactcttccatttaaaggtaaaagcagaataaatcttccctgactttggttaggcaacttagaccattcccctgactaacctacagctatgttgtgggctaaatctgcatggaccgatggaagaactaacagcaaataaaatctgaaatggagagcatgtcttagaatttggaataaaaataaatgtgaagaaactaaactgctaacagaacaggtgtgcacacagttagaatttctaaagcttttgcataaagtagtagtgagagctgtatgctccctttcaaagcaggaaatgtgagttcccaggtttcaaagggtcgaaacctcttttttgcttgccaaaactccagaattctatgccttacagagttaaagaacccctggtcagaggcttaattttatcaaatttttctaaacatgcatgtctgtcaagaatcttaaatctcctacttaaaaatcattcccactactataattagaagaagataataattattggtttgggatttttttaaacataatagtgaccacagtataactaaattgtttcccctgttgggtgggcagatagtgccttttccttctgtgcgtgtcttttcttctcatttttccagcaaaatctctaccttcccagtttctcatgattcctagtgtccactgctaagactcctggagtctaacactaaattctgtgattcatctggaacacggtaagtcgccttaattatgtacaacatgaaactaaaataaaatactaccatgcaatatatttaataggatttgatcttctcttcctttatttttaatgcaagccaaatgaaaccaaaaaaaaaaatacttcaggaaaagaagaagcctaatgagcctgctttttactttgatgtggtcttcaactgaccttttactgtagatatgtggtccttaattggaggagagaaaaaatattcccaagagccttctcagttccccaaaaaagattccaagcaacatgttctcaactccggaactcagaggccacctactagttggagcaaagaggaagcaaaagtccataccacccattacccccacctctacccactgtcctctggtccttatcccatgatggtgctgctgcccacagggtcacccaaggtaaaggctttcaggagagctttgattcctctctttcccttacctcctacaaccaaaggtccctgggtctctattaaagcatttctaaacaccattctttcctctccctttccctcccctcctcaagtcatacccttctctcaggtcttctgtgcatctcagctggatttccaaccagctcccaatgggacttcttgtcctgcctcccaagtgtctccagagtgctggttctaaactacaaatgggatcacaccagttcctgctcagaaaacatgaattggtcctcattgccaaagaaggttcagaatatcaagcatggctaaaaggaccaatgtgatctggccccagcccactttttaatttcacctccactcaattaatggtagcattcagtggaatttgatgaataaacagatttgggtcaagaaaaaaagagtgtaagattgtggcaatcatgacacccaacactacaaactgcataatctcctaagggttgtgccaagggcttcatgtgcattatctcaatcttctcaacaaggcaggtcttattaggtcccccacttgtcaatctgaaaacaggctgcacagctcatgaagtgacaaaggatgaagctgaatccaagtggaaatggcaatgtccacatccttatgtatataccacactgcattccacacactgtcaacatagggagcctgggtgacctggagtatagcggtgtggatcaaaattttgttgcaaatacccaccaggtactgatcatgatactcacttcagccaaagcccctaaaatgtgcaaaagagagccccttattgaagctaagagctcagctttcagagggttcagaagacatcaggagttctgagttccagagagagtagaaaaagccaggcacatcccatgctcataatctaaaaacacaccggcttcagttacctttcccaatcatccctgggtatatgcagagggaaaaaggatactgaaggatcccaactcccagtaaccccttttgtggagtccactgctcatcaagcaccattctaatccctgctggcttgtggtgtggaacaatctatgaaaatgagaatttacaaagcagtagacctcaggacctttgctcatgctgttctctttttctagaccaaccctaactgtccacaaccctcactatttgtcctaattaatgactataccatccttctatatcaagtgggaacatcatttcttcagggacaccctccctgagtatatcagatacaccattagatgctcccagcatgttcttcatcacagcacccaatgccattataatttttacctttgcttttgtagttacttaatgtatctctctccatctcggttacaagcttcatcatagcagaaactgtgtctattgctcagtacagttcctggcacagagtaaatgaccaatcagtccttgaacaaatgaatgaacaagcaataattttagccttcttaacagttagatttgtcattataaattagtaagttcagcatctggttttggcaccagtgtcttgtgaacttggtcagggaagcagtctccttgaagctgaccactcagccagccctgaatgaatgagtctggcacctgtgaagataaggaatagatatctctgaatagatattggtgaccgaacacagcccagcttgggcatccaggtgattttttttctctaatatttctctctcatcccttgcacccagaaaactgtgtccaggagtggtcactgcattacttatagacattactaggcacataaattttggtttgatagctcctgtttcacgcacactcactctctaaaatgaaacaacaaatgcaaggtggcacggagggctgggaaacaacaaatgccatagggaaagcaacaaaaatctaactcaaacaaacgctttccacttagagatgataaatacaacatgccatggcagcatacactgtcagcaggctgcccctttaaaaatgtaaccatcaatctgttgttaagcccacaaccagttgcaatattaatcatacttttctggcaaaagaatccatttcccaataaagtttgagtggcagagaaaaggcagagccaacaatcaggaaataaactctgcttccaaatgatctaaggaagctgctcttcttgccggctgctctctcaccatcctgctgctagcaccagacacacataaatacacatgccactctgcttcccccacatcatatttccatcattgcagagtgctctacagttctgttctagacccatttttcactttgtgccatttttgtatactttgaacccagatattccctggaaattaagagtcactttttaagcacgaccaccacctctatttagttgctcactcataacctttctttcctttttcttttttctctctccctttctctctctctctctccctccccccccccagccccctctctccctctctatttctctctcccccctgtcctctaccattaacctggaaccaattatgataagcaccatttctgttcttctgcctcaccttcagtcaactctcaggatgctacacccacgttgcaggctgtaggaaaaattcccactttgatccattgttattttttctttaagtagttactcatgaatattttccttcaatacaaatgttaggatgtcttcaaccaaatccctctggaaatgctgtgatattattgcacctatgttaaatatataggctaatttgtaatgaataccatatctacaacactaagtcttccttcctatccataaacatggtatatctctctgccttctttcataccctttagagtttctccaggcaaactgcatacaattttggttaggttaaatcctagatgtattacagtggttgctattgtgaataaacatcttctattatatattcttaatttattattgtggtacaaaagaaagttattaattttcatatgtttatattatccaacaaatttgttgaaccctctactgctaagggttggtcggttaattatttttttctctaagtaaatgatgttatacgcaaataaaccatttttcttttcccttccaatccttttaactttctatctgctttaatgcattagccagaagctttagtttagagtagtagcaatcatcatgtgtattcctatttctttctaaccttaaaagaaaatgcttctaaaatttattaactaaccataatgtttgcagtaggctttcggagaaaagcctttattagattgagaacatttccttccataatagattatattattgttctcaattatttgctgcctctctctaccaggcctacctccatggggcccctcacattgggcaaagtatggagccactacactgacatcagacttggccatgtgacttgctttgaccaatgaactatgaaaggaggtgacatatgtcaagtccaagctgacacttggagccattacatggtgcttctattgatttttcctgtctgctactgtaccaccacatcccaggcaggggctgctcctccagcctggctcctgcagtgacgactacagagagcagaaacacagccaacctacaaccaacatgcaacatgtacaggaaatcaacctttgttatcataagccactgacattttggagttactgctacagcataatgtagcaaaagctgactgatatacaacctatttttatttttctctgggcttttgtcataatagctgcctttactacacccattgagatcactgtatggttattctccttttgtctgttaatgtaatgatttcagaggttaaatttgtagcagacattagctgtccatcaaaaatactagtgctcttcctcccacagtgtggtattttcactgggaaatggctgcccagcctgtagctacactctccagctcttcttgcatgtagaggtggccatgcaactagttaccaccaacagggcatgagcagaagtgacatgtcacatgcaggtccagagctcttacaaagcagttagagattctcacattctttatttttctgctggctggaaatgcaggacatggggccttagtgagaagtcgaaccacaagatggagggagcctgggtccttcagtcatcacatggatcacctgccaaccacggcaccattccatgagcaagaaataaacctgttgtatacaggtgcttatttgttagagcaaccagtgttaccctaatacaccatccttgcacttcagggataaatccagtgatatatgattttttaatacgatgttagatttagaatgttatcattttatttaacttttagctgaagctggcttgtcatttgtcttctttggtactatcctcattcagttttgatactgaggatataaatttggtattacacttcagaaaataacaagagcagctttctcctttttataaatctctggagcaacttgaaccaggcagggattatctacttatataaaactgcatggccctaatgattttgggaggaggagaaagtttttgccatcatttccatttcttcagcagtgattgttctagtcaagttttccatttatcaattggccaacattggaatttcatattttttctacaaatctattcatttcataagagttttcacatttcacatttcacagctatacatttgtttatatacagttgctgaaccaaatctcttatgatatctaaattgcttctatagctatgattatttcatatgcaccttctctctttttattccttgatcagtctctctagaggcaaatccatcttcctaattttttcaaagaacatttggttattctaatcattattatttttccatcccccttttattgatttttactctaccttattattttaatccttcattgactcagagaatatggtctgaatgatatcagttcttagtccaagactgactttctgacctagaatataatccatttttgtgaaaataccatgtgtgccccaaaataacatgcatttagtgttttctgagtgtgggattgttaattgtgtttttcaaatccttctttgtcttttttcccagtttgttctgtttccaagaaaattatattcaaatctccatctacaatggagattatctatttaccactataattcctccaattattactttatatagtttgaggctatgttgttggttatgtttttgtcatcactattatatcttcctggaatattgtggtattgtggcattcccagaaaaaaccatttttcatcttttttgatgttcaccttaaattctacttcatctggtattgaaactgctagcctggtgttattgtggttattttcctagaatgccattttatccctttattttcaacctgtgtctttgtttatgtgactgtcttaaaatcacatattgcctgatcttttctgtaacgtaatctaagagtacgtgcatcttaatcagtgagattaaccatttattctgtaaccactgatactgcaggtttgatttcctcaccctattttgtgttttctatttactatgctttttttattttctgatctctcactgaatatattattttcttagttttagcttaacaaagtatatttttatgatttccatggttgcccttagcttaagtaaggcctatatttatatttgtttattcctttaatatctaaagactattcatgactatatcctccccacagcaagacacaacccttggactgctttcctctacctgtgatctttcacacacactcacacacacaaacttcatttctcatgttagcattgtctggaaatttagttccaggttggttatgggtcactccctccccctgttttttcagacatctccagaaccctgagcagaggaagagaccaggagaccatgctttgtttaccacattgattcaaaccagaatttaaaaccagcccaattgtgccatgaaactaatgcttatgggtttttttgaataaacatagaaattgacccccccaagtcttgaaattaacaaagttgcagttgtcttatctgagttcctctctcaggaaacaactatcaggcctcccagatagtatcaaagagctgaaactcatcagataacacctggacaatgagatgccagacccctcactcatcatgatggcctaaccgaccacctgcttcctgctgacccactcttcttcttcacccttccctaattcgtatttttccccatatagtcagatttctttcctgctatataaacccctaattttagtcggtcagggagatggatttgagactgatctcccatcttctcagctgcagcgcccgaataaagccctcttccctggcaatactcattgtatcactggtgggctgtctgtgcagcgaacagcaggacctagactgaacccctggtgtttcagtaacaaattatccttctcatttcttattattttttgtttattgctcattgtgagttatttagaatactgattctatgaatgctattattttgaatgcttttttgaggtataatttatataccataagattcacccacttcaaatgtatatatatatatatatatatatatatatatatatatatatatatatatacattttttgagacagagtctcgctctgtggcccaggctgtagtgcagtgtcacgatcttggctcactgcaacctctgcctcctgggttcaagcacttctcctgcctcagcctcccaagtagctgggattacagtcacgcaacacctgcctggctcatttttgtattttaatagggacggggtttcaccatgttcggcaggctggtctcaaactcctgacctcaagtgatctgcccaccttggcctcccaaagtgatgagattacaggcatgagccaccgcacccagccttaaatgtataatttaatgattattatttacggagttgtacaacaatcacaccatcaccacaatacagtttttagaatatctccatcactccaaaaagatccttcatgcctgttcacagtcatccctgttcacagccatccctgttcccacccctaccccaggcaatcagtaatctaccttctgtttctatggattcaccttttctggaaatgacctatacatggaaatatccaagatgtggtcttttctgacttgtttcacttagcatgatgtttctgaggttcatacatgtggctgcatgtgtcaccatccatttcatttccttgctgaatcgtattgcattggatggatgtgccatgttttgcttatccatttgccagctgatggatatttggactgtttccactgttgtgtacctgtgtcttcctgtggacgtaggttttcattactcttgggtagatgcctaggagtaaaactgttgagtaatatggtaaatttatatttaactcttctaagtgactgccgaactgtttttccaaagtggccatgccattgtacatcctcaccagccctgtgtgagggttccactttctccacatctttgctgtattagtccattttcacattgctatgaagacatacctgagatggggtaatttataaaggaaagaggtttaattgactcacaattctgcatggctgggaagggctcaggaaacttacaatcatggcagaaggcaaaggagaagcaagaaccttcttcatatgatggtaggagacagagcaagcaatggggaaactgccaaacacttttaaagcatcagatctcatgagaactcactcactatcatgagaacagcatgggggaaaccgcccccatgatccaatcacctgccaccaggtccctccctcaacatgtgcggattacaattccaaatgagatttggaggggacacagagccaaaccatatcatttgccaacacatgcttttaatcatcgtttgttattgttcttcttgttgttacatccattctagtgggtgcacttactatatttataatcagaaaaaaataagcatgtagataagtatatgaaatttatgtatataccatatcttaagggagaaaaaagaacaaaaatatcagaaggaaatacaacaaaatattaaatatggctgtctctagatgacaggattatgggtttttcttctttctacctttctgtatttttctctttgataagcaacaggtatttgcttttataaacaaattcattttaataaagtaataacataccatgaggtgttttacagctagtataatctaactttaactaccttaacatttcccagtagtgatgattagataccaaagcttcccttctgctaaagatcatacatacattgttgaattactgaagaaattacttgcctccagattgactcgcagggtaactgttggttttattaaactccagagaagaactgcagagcttccagggcccttcctcaaagcagctaggaggcatggatgcacagctgtcaccgcattcctctcacagtgcttcctgggccagcatcaaggctattcagaaacatctcattcttttacaaccatcctttgctcctacaccaaactctacaaggtgtatggcattcaagtagttttgtgtttggctagtgatgacaaagccaccccatcacaaaaaactgtttatatgctactctattagcatataatctgggaatcttgccgaagcacattcatccaacaagtattatctgagccccaactatgtgaaaagcattgtattagtctgttctcagctcctaataaagacatacccgagactgggaaatttataaagaggtttaattgactcacagttccacatggcttgggaggcctcacaatcatggcagaaggtgaatgaggagcagtcacatcttacatgccagcaggcaagatagagcaggtgcaggggaactccccttttataaaaccatcagttctcatgagacttatcgactatcacaagaacagcacgcgaaaaaccctcccccatgattcaattaccttccaccaggtccttccccgacatgtgagaattacaggagctacaattcaagatgagatttgggtgggaatacagccaaaccatatcaggcatcttgctgtgtccccttaagcttacaatctaagaacaaacactctacccaaagtacagagcgctaaggatcctaagggacaaacacacagaagggcttgtaggagtttggaaaagagttgtcttccccacccccccacaactgaaagaggaaagacatttcaaggaaacagtcacttgccagttttgggtatcattgaacatggaaccagaggtccaggaattacacgatggcccaagacaagcatctaaagggcaagaccaaaggaagagcttcccttccctgcacccattttccctctcaaatgatctttccctgatctttattctctgtcaccaccaaacttcttgcctctgtctagacaggcatacaagggccaaccaacccgctgtgaataggtgcctcaggcaactgaagtccaaatagaatgaggcaagggcgccctcactcaactcatccaaaacgagaaaaaactaagaagtcccaaccagagtcatgtttcttctacaccatgacactgcatgtgtaagcccaccctacatccttttaagaatgcaacattttacaaaagaataacttaactgcacatcatatgccaccgttttatgctaaagatcacacgtactgtgttgaattacttcagaaatgactttaacatcgacagccaaagcaaaacctttaactagaggggactgggtattttggcctgatgaataatttgcactcagtaatagggagtcatccaagccaccaagcgtgaattactaattttcaaaagaccaaaaactaacaaagtacattcaaccttaaaaccattttgaacataatcttcctttgaggattcaaaaatgcctagaaacactttaaatctgtgaataaggaccacgactctgtgttgtcatatccatacaaagttattgaataaaacctagcaggcttagagcttactaatcctactgttataaccgggggctgggagggaagaattgctcttctaatagtaaatgtaggtaaatgccagcagaactgggtataagagatgtgcctattaaggaatgtcactggttttattttaatttattctgggtttattggatacagcaaaattcaccctttatagatgtacagttctatgaatcttgacaaacatatacaattgtgtgggcaccaccataatcaagatataaaatgttcccatcactttcttaaattcatgcccctttgcagggaaatgcccctccccatttccccagtccctggcaaccatgaatctaatttctgtccatacagttttgtcttttccagaattatgaatctaatttctgtctctatagttttttcttttccagaatgtcacagaaatggaatcatacagtctgtagcttttgactctggcttctttcacttaatcttttaagagctatccatgtcattgcattgattttgtttgttaaccaatattgaaccgagacttcaaaatggtgctggtggcctcacacccaccaggttcttcgtcactgttcacactgtccgtcctttttttttttttttttttttttttctccgaaacagggtcgcccaggctgaatgcagtggtgtgctcttggctcactgcaacctccacctctcagattcaagtgatcctcccacatcagcctctcgagaggctgggattacaggcatgtgccaccatgcccagctaatgtttgcatttttagaagagagagcctttcaccatgttggccaggctggtctcaaactcctgacctcaagtgatctgcctgcctcggcctcccaaagtgctgggtttacaggtgtgagccactgcaccttgcccacattgttcttttcaggggcctctgagccactcaataccttcttcatatattaaaggagggacgaatcttcatctttcaaaagggagggcgatggttttaaaagcaaagctctaacctatgagcttttactccaggacacaaacactggcctatggagctctgtggcccaagcacagggcagggtactcagtgggggcacaacacagaggacactgaaggctgggaaggggaagaatggatgggagcgagattcattaaaggttacaaaattacagctagataagaggagtaagttctactccataccactgtaagatggctgtacttaactaaaatattctagtttcgaagagttagaaggaggatacggaacatttccaacacaaataaatgatcaatgttgagacgatggatatgctaattacctggatccaaccactacacattatactgaaacatcactatgtgctccataaatatgtacagttattatgtgccaattaaaaaaatttaaacctgttggttcaacttgactgaactgcaatctgatcagtagtcaacatgaataataccatcttagttcaagagtaaaacaatctcactgagaaaatttctcagaaaaagactcccaaaatgttatattgtgttaggttttgttttgctttggggtgtgtgtgtgtgtgtgtgtgtgtgtgtgtgtgtgtgtgtgtgtgttgaaaactggctctgaaagcatttctaaaagtggagtttccaacatcatcgtgaatccactcctgcacctcctcattgtacaaatatttactgagtgccctgtgtggctacaccaagttcactgctaggaatgattcaacttctaaacaccatcaggaaagtacagactctgggttgagatggttctgaaatcaaattcccacttttggccctttaactctgactctactgccctagagattccccagcagggtcacccaaacagagcttgatgacccaggtgctcaaaccctctgcccaacccatcctccagcacactctgccgggcccatcttttgtggtctgcacaccttgcttgttaccagtggatctgcgaaactttcagaacatccatcctggaaaaatgctcacctctgaataataatttaagtctcgaactgtcatcatccagggaagaacttctcactctgaatctgtcgtgattctagagcattcctagaatctagaggttctagattctagatcctgactcctatgcaagtagctcggcaaggagaggggagcaatggctggagaaagtgataaattctctaaatctggtttttctcactcataaaatagagttattaatccctccctgctgcgaggataaaataatggataataataatagcagctgttattaattgaaagcttatttgagggccaaataccacagaatatgcattacttatttattgattttaatccatgcacccaatcttatgagtaagactattattatccccaactaataaatgaggaattgaggctcagagatactaagcacttgctcaaaaccaccagctagtacatgcttcactgagggtgtgaactcttcatcgttatatttaacctcattcaacttctggcaatcaatcccaaagaaataataataagtcactcatacacacagaggcgcctcatggtttgagaagagaaaatcagaaaataattaaacatccaacaatgaggcattgctaatataaactgcctccatgttggtcaggctggtttcaaatcatgactgcaaagaatagtctgtgaagaccagctgaagacatgtgttcacctcccacttcttcccaaaactcactgatatcccagtaaataactacaagtgagacaatatcataaaatcactgtgaactgataaaacagaagccaggtgaggtggtgctggtagcagaaccagggcaaatggagaaggagagggaggtggaatggtgaggagaaagaagctgtttcccatcatggaagcaccagcatgggtggatacagataccaggagttggaggaagggcaccaatggtgaaggctgtctgcaggaagagtccatgggctggcctcccccagtctactcaacaatcacctctcacctcttcccccaagagcagcaaatgaattttcccaggctgaaacaggaaatataaccactaaggatccttaacaatcttccaagaaggtgcttaaatttccagagtggggattatcaccccaaaatatgttcctctttggcttagcatgaggagcagcacaacttgcctgcttttgttccacaaatgtccaagtgaaatccgccaatcaactcacctgcccgtggacaaacaaaactactcagcaatctgtgccaccacctagttctacattcctaaaatgaataaacaatccaaatcattaatgctggtggaggcaaacaataccaaagaaagaagtaagctgaacccataaaactgactccaggaaaaatagagaatccagacacaaacaagaactttcacagaacccttaattaatatcttccaagatactgaaggagattttatacacatagaacaagaacaggtgactatttttttttttttttgagatggagtcttgttctgtcgcccaggctggagtgcagtggcgccatctcagctcactgcaagctccgcctcccgggttcatgccattctcctgcctcagcctcctgagtagttgggactacaggcgcccgccaccacgcctggctaatttttttgtatttttagtagagacagggtttcaccgttttagccaggatggtcttgatattctgacctcgtgatccacccgccttggcctcccaaagtgccgggattccagtcgtgagccaccgcgcccagccacaggtgactatttttgaaaagcaattaaaactcagaagtaacaaatttacagaaattaagaacatgcctgctaaaatgaacgccaaaggaaaaaatatcaatagaaaagctgaaataaaaaattaaagaaatttcctagaatatagagcgaggagaaatatttagaaaacatagacaaaataacagacacatgaaagaccataccatgaaacaaatatccatctactagatgctcctagagagatcatagacaaaataaacaggaggaaataattaccaaaaatatatatatacttcacagaaatgaagaaagaaagaaaatgcaaagtgtccatcaagtgccgaacaggataaatgaaaaataccttttaaaaaatcctggctgggcacagtggctcacgcctgtaatcccagaactttgggaggccgaggcgggcagatcacttgaggtcaggagttcaagaccaacctggccaacatggtgaagccccatctctactaaaaatacaaaaataagtagccgatgtggtggcaggcacctgtagtcccagctactggggaggctgagacaggagaatcgcttgaacctgaaaagcggaggttgcagtgagccaagatggcgccactgcactccagcctgggcgacggagattccatctcaaaaaaaaaacaaaccctgaaatcttccaatgtatgtgtgttgagagaagtggcgtgcagacaaaacaggtaatccatgaaggaatggggattttaagtactgagctaattagcaatactgaatgttagaagacgactggatgtactttgaaatgtcaaggagaaaattattttgactctagctttctagagtctctctctctctctctctgtatttctctctctctctctcccccctctctttctctctctctctctctctatttctctctctctctctcccccctctctttctctctctctctctctcacacacacatacacacaaacacacacacatacagaatgtgaggatgaaaaagagattttttcagcctttaagaacaaaaagttttccacatacctattattttataaaatattaattaggaatagactgagacaaaatgaaaaggaatacaagaataaaagaaggttggggattctagaaagagaagaattccaggaccgcaagaagagcagccccaagatgatgatgagctcatggtcccaggaggaaggtaggagagcacttcacagcgtgcaattgaacaacggtgagatattcatgattcggtgaagaagacatccgcttcctccactcacaagaaaagcaaatgacaattagaatataagaagctgtacaataaggtcacaggccagcaaaatcaaacataacatgccctgagtctagcaactgatggagtgatcaagaaagcaaattcatctcatcacagttctgggatggggtacggttctcactgcagagacattcatccctgtcttgcctgggttttctcaaaaaacaaagcatacaacaaggacacatgggaaagtggtttatttggggaagtgattccaagtgacagtatggcaaactgggaagagtggaacagcaaaggagagaaaaatcaatccaggagtgtagcacacagtggatccccacaggggacaaacgagactccatcccactctgagaattatctgcctgggagaaggaagatgagaatgtgtactcatcggcttccatcccccattgaccaagggctgccccatgggtctggcatttccagatgtccattacatcagaatgtctgtgcaggaggcttcccaaatgccagatacagaaaagtcccaggatataaagtgagaaatatgcattgtagtatttagaactgtattttccacatacataatattttgtaatagtaactgtgttaaggagagacacaaatactatgtagacattagcactgcttgccaaatgtttttggctctcagcttcccaaacatacgatggaatcacactctttggcccctatgtggttgagtgcaaccatgtgactagttctgcccactaaactgaagtgaaagtgatatctcacttccacgttaaaacatgtgaattttgacgcaagacactccagagttttctttcctccttcttcttcctttccagcaacataacagataacagttgttccatttccatgggttgccaaataaagaggacccacagcagaggcccagttcactgtaatagacatgagactgacgagaaataaaaccttccttgtgtaaaggctctaagatctggggattatttgttactgctgcctaacctagcctatactgactgatacaatgaggcaatgctttataatgttgtttgggaagacaagtttagaaaagttaacacacacacatatacaatgattacactgtacatttaaaaagctaaatatagagaaaaaagggatatcaagtgctaatagtgtatgcccttggttgacagaatcccaaggaaggttcattattagatggtcactttttaaatcttacataacaagcatgtattatttacacaaaaacaaacattaaaagaaaacctcaagtgaggggctgtatcgaggaggagagattggtggacatcccagttatgtcacgtgcttatgaactctaaacttcagtaccttttccaccccataaaatacacaaatctcttttcaggtatcagggcaggtgggtgtcaaatacccaaaactttacttccactttacaatgtgcatatattcaaagtcttccaaacatccaagaaagttttagttgtacgttggactgtttctactcccttcttccaagtctcccaataacttgttcagcttttgcaaataggaattgtttcccaaaagggaaaagaatttgagaaaatccagtgtctagaacttaccaacatgaagccttgtgaatgcacaggtgtatgctcacacgcatgcacacacacaacaggtctgttaagtcctttctgggcccagtcttccaatttcttccacatccctctgatctattttccaagagcagccagagtgatcctcgggaagttaacacttcatgtcaattccctgctccaatgccccactggcttcccattacacttatggaatgaaatcgaaacccctaaccatggccctggagatgcaggtgatctggcccctgtcccactcttcccttgacccagtatgtaccagccatgacgatattcctctcaggtccctgaacacaccaagctactctttccatgtctgggcccctgtgctgaccatttccccttcctggaatgctgttctctggggttcccacaagccttcttccttctcaaccttcaagattcagcctaaattccacttcttcagggaaaccctccccaaaggccaccattaaaaatgagccccatccccgtcattctctcccactatcctgttcctttctttcagacacttcatcacaatcctatttcttctctgtttttttctttctttctttctttttttttttttttttgacggagtcttgccctgtcgctaagcaggagtgcagtggcgcgatctaggctcactgcaacgtccacctcccgggttcacgccattctcctgcctcagcctcccgagtagctggggctacaggcctgcaccatcacgcccagctaatttttgtttttttagtagagacggggtttcaccatgttggccaggatggtctccatctcttgacctcgtgatccacccatctcagcctcccgaagtgctgggattacaggcatgagccaccgcacccggcctctttcttttttttttttttttttttttttcagacggagtttcgctcttgttgcacaggctggagtgtaatagcatgatctcggctcaccgcaacctccacctcccaggttcaagtgattctcctgcctcagcctcctgagtagctgggattacaggcatgtgccactacacccagctaattttgtatttttagcagagatgaggtttctccatgttggtcaggctggtctcaaactcccaacctcaagtatctgcccgcctcagcctcccaaagtgctgggattacaggtgtgagccaccatgcccggcctcttctctttatttatcaccttaggtgtttattgtttggcttccctgttactacgggagctctatagggcctcatctgtctacacatggctgcatctccagcatttagaagagtgtctggcacataatgagtgctaataaatggacgaaggattacagacaggctgtggaaaggggctaacaggggtgtgcacagagtatggaagaagatgaagcaggttaccagggtagatttctaagagaaggggatgcttaagctgaacgttgagggatgatcaggtgttcagggggaaaggcatgagcagcgagggaaacagaggtgtgcaaaggcctccagccaccaaaaagagcaggaccagtgtctggggaggtctttctgcattttggatattgagtgtcatgcccatttgggagccttggagagagcttttatgccagccacctctgccttgggagagacaaagcccatttccatctgggagctgggttggtgcaccccagactctggttcctgagtgccacttgcagggtggcctctcatcaagcagtttcacacccagtgatacctcgtactttcaccctgtcacctgccattagtcatttctcccaccagcactgagaggtaaatcactattattatttttcagttttacagctgagaactaaagagtgtggaggttaagtgactcgtcagagttagtggccagatggggttcagaattcagcacctgtgatcacacccaaggcctagggcccacaacatttgtgtttctggacactcaaaccagaaggccccatgtggctggacatgtctgcatggctccccacccaccttgcaaattttcccagccccccggctatctctcaccctacttttctccttccttgccctctcctctctttcttctctctcatctctctctcccccaccgatctctctccctgactctctcccacctctcttccctttctctctcccttctccctgccctctccctgcttcctctctctgtctctgtttcttcctctctctctctctctgctcttttctccctctccttctctctccaacctctccctcccttttcctctctcttccacacctctctcctccccctctttctctcccccaccctctctctctccctctccctttctctccttctctctttccaccctccctctctctctcttcccctctctccccacctctctcctcccgctttctcccctcccacctgccttctctctccctctctcccttctctttccctctctctccttctctctttccaccctccctctctctctcttcccctctctccccacctctctcctcccgctttctcccctcccacctgcctcctctctccctctctccctctctcccttctctttccctctctctctccccatctctcctctctctccctctcttctctgcctctccctgttcccccttcttctactctatctccccgccttgctccctcactctctctgtctctctgttttccttttctccctctccctcctcttttcctctctctccgaccctatttggctctttagattgaaaacttcccaccacctgacttcagacagggatgggatcatttgccttctcttcttaacagtatcagaacctgtaggctcacaggctcctttcttaggagagcccagcatgtgaggaagggctggtgatcccaagtgagagcatagaaacatccttggggagtcagctttgggaagaggctgctggcaagtaaggcctaatcctcatgcaggagctctgcgccccattcagcagctgggcccctcctcctcctggggctcctgacagagggggttcctccactcctggccggttccccagctcagcaggctcccgccccccatccacagctctgcctgtgtaaggccagaagcccagcatgcctgcctggaatactaaacagggcccttccagatccagatgcactgagaaggccagacaatccctcacctcccccatccccaagggcctggctggagagggctggaatctagtgcattgcagggagcagggaagctcatcacagtcctcatgtggggacagaggaggcccctgatccctctgggatgtgggtggcaggctgccagctgaggaggttggaggccccaggctccccttccagacagcataaatccaatggtgtggggtccagctccctgtggcccagcacacaggcaggattgcaaggatgaaggcccgaggtaagtttggaggagattaaattaaaaagccaaagcttctgagcaccagaaggcctcagcgaccataaatctacttgcagaggagcacacagaacacgaggccaaaccagttttatttaagttgctgatgagcgttggcctctgcaaaggcataattcaaccacacttgggcctggacagtccctgcttccaagcaatgcacagtaagggagccaggaagtggaagtatggaacacttggacagtggcgaggggcctgagctacaggatcagagaaactcatgctcaaatcccatctctgtcatttctgggcagtgtaatctcaggaaggtcgcctaacctccctaaccctctttttccccactcagaaaacgggttaaaccagatggaccttccagagtcattgtgagtacctgccccacaagccccaacaaaatggtggccatcacaacaaagttgatgatgatataggaaagtgaagttaatggccacagaacattaatgagctaacacaaggcactcattctatgccgggcactgtttactctttcagtccttagaatgatactgtgataaaatgccatgatggttcccagttcacagttgcagaagctgaggcacagagatgctgagaaacttgcctaaggtcacatagctggttatggatagtactgggattcaaacctgggcagccaggctcttccacagtgacagacactgcactctcctgactctcagaatttgagagcctaaaggaacacaggaatcattttttccatattcttggaagagggagacacctaagcccagagggcaaaggacacctccagacagtgacaggatagctgaacaccagccacagctccttagaggaaacagcacaggggtctttatgatcttaagtatcttctgtgtggctctgacaaccccaaaacttctcttgttacatgaaaatcagcttacattaatatggatgcaagatgcaagtgcagcacagtgcgcgggctgtacaaagcaagcagggaggcttccgaagatgacccccaggctatgccttggcagtccccttcgccagcttccatcccccgaagccacgtgaggaaggccagaacaccaaggtccctccagaactctgagtagagaaacagagccagccggcccagccatccccagagatggaaggaagctccaaggggactgatgacaagctaaaatttggaactttatcacagactcatggttaccaacatcaaatatttaatttgcagctaagactctttttgcttaaagccatgaagcagcagcacagcatattggctgaatgcacagaccttagagccagacagcctaggttccggtcccagctgaaagaccttggccatgtgactcaacccttctgcctcagtttcctcatctgtaaaatggatataactgaacttcccaggatcattttgtacattaggaatattcatattaacagagtacgtagaatattacccaatcccctaagagtgccaggtaactaagtattcgttaaataagaagcgctccctcataagccagccctctcttcaaaaggtgacaactcttttttttcttttttttttttttgtttgaggtcttccttaggatcttcaaagatttcaccgaagaaccagcatgtgtccctgacctgatggaatgtgtccttaccaggataaaaaatcgatgcaatactgttggaaagtgaccccatggtttgaagcaaaccaaattatacgttaaagcaaaaaattacctccagaataaacgctaagcacagtgactgtctacaaaggccatgttttaagcattcgcactccaggaccctgggcttagtggcacattagacactcaataattgcatatctagcattcagaaacttttaagtggttcttattttgattcctttcccctctctgtagtgggaactgccctcaatcattctgacaggtatttctcttgccgcccacaaattttcagccctgcagtataccacattggtctggactctagcatatgcaggatttatgccaggcttgcaaaagatccctgaatcagccagtccaaaccccctctttgtgccatgtctacctcgggtgatggcagtgtgacagcattctcacctccacccccaagacacacacacacacaccctggatatctcaccataataataatgtattttatatcatgagcaggggaatacgattaaatcttcctcctataccccaggttcagaaaagaataataatgatttcctatattatgtggaatctcatagttcacaaaataatttcagatccaccatctgctttgaatgtcacagcaccctgtgtaataagtaagtcaggaatggtgtcccattagccacagatcaaagaagcatggaccagagtaaggaagcaattttctgaaggacacacagcaaattaggaggaggaatggaccccacacacaagtctgtgtactctgggctaatgctcttcaaggcctttttcctccttgctctgagcttacttcttgcaggtgtcagaaaggtacattgataggacaacttgcttcccccagacagccccacctcttcaaagatatccacaagtttgcccacacaagtattccatccctacctcctaatttccacctttacaaatggcacgtcccagccccacattgcccacagcacctccgggtctctgcttctgtctaaaatcctcatctccattcttgtgcctccaatcctgccagtctttcaggcccatctttaacagctctttatccaggacactctctgatgctgccatcacagcctgcaacagccacaggagaagccacccctctctgtatccctgtaacccttgattcttcctcgcatggtcatcatttctggtcttgggacttctcttctattagcccagtgggtacctggagggcaggaaccagggtacacttgccttgggagctcccacagacctcacatggtacctacatctagtagggactcaatcaatatccatgcattcattgtattaatcttggaaggaagcacaatgtgtattacatagagggaggtttacctgtgcaaggacaacccctttataaattcaagaatatagacacaatgtgtcgggcacagtggctcatgccagtaatcccagcactttgggaagctgaggcaggtggatgacttgagatcaggagctcaagacaagcctggccaaccagggtaaaaccccatctctactaaaaatacaaaaactagctgggcatcatgacacacgcctgtaatccccgctactctggaggctcaggcaggagaattacttgaacccaagaggcaggggttgcagtgagctaagatcgcgccactacactccagcctgggcaacagggtgactctgtctcaatttaaaaaaaagaaagaaagaaaggatatacacacaatgtaaaatcactgcaccgagtcagtataggggctgccttaaactcagggaacagccaaatctgtttatgaattaaaagaacagtcactaaggaggcaagatcaagtatcatcaaaacattaggccttgacatagaacctgaaggattcccccaagccctagggctgtatccagacagaattttcattccataactatcacaaaatgtctctttcatttccagctctgtgttagaggtcagggacataaacggctctcatctccaggccctgccatgatggacctcacagcctaatggggaaaagagacacaaaaccagacaatgacagaacaatataaaagcactgggggacacccagacaggcataatagcgcaaagagggaaggtgcccaggtgggagaacctaggctacgttatgaagatgacatttcccatgcaaatacacataaacgtgtctatcactcttgtgcacatgtgtggggctgtgtgttgggatggcattaatagtagctaaggtgttaaaaaatacaatactaaaattcccaggcaaagcaaaagtttccaccaattatccgaataatttttccaaaagttcagataataggcacgtttaagaaatttctggtacaaagaaacaaacatgtggctaccttttcctttttagcaggatgctttaatgccacataaacacatgctcattaccaagctgaaagctgatttacatagcatcacctctgaagcatacaaagataagaaaattcaagtgctccgaacctcagttttcttaacaataatacggaagtaaaatacagacctcgcaggatttgctggggggagattccatgagatgatgtatgtaaaagactctttgcaatgaaaaccacaatagcaagctcttgatcacttttagctcacacgctgggaatcagcatagtattatgggcaggaacatggactggagtctgtggatgtgggttcaaatcccagctccacccaactgcaatgatctgaggcaacactacctatgtagcctttcttagcctgagtctcctaaactgtacaatgaggattttaatgcgtacctcatagctctaatgattaaatgatgtaatatggtgaaataccacagtacaggtagtaaattctcaatacagcataactagcatcatgttactcttgtcaaatattttgtctaatatttcaagggaaggtcagaagatggagttcacaatctacataatccacagatgctcaggtgttacaagtagtgggagggagacggcacaatatgggacaggctaagagttctgggtctgattattccattcagctgctggcatggggctgactctgggagacagccacccacagtcatgggagtaggggcaattctctgaagagggcaaaaacaatcaagggtgtcagctgcatgtctcagattattgattatcttcatccatttgtgctgctataacagaatgcctgagactggataatttatacacaacagaaattcatttctcacaattctggaggctgggaagtccaagatcaaggttcagcatctggtaaagacctattcatcatagatggcaccatctaggtgtccttacatggcagaagggacagaagggcaaaagggcatggagccctagctaattcccttgagcctttttagaagggcactaatccattcatgggggtagagcttcaccgcctcatatcatgacattgctgatgaagtctaaacatattaatacagggggcatacattcagaccatagcatatgtctcatgtacttacatttgaaataagaccagcttttcactggacatctctctctctctctctgtctctttcactcacacatcacacacacacacacacacacacacacacacacacatacacttcctatgaggagaccccagacatctttttaaatgtgtacaactagttttggaaaataaaatattcagctgacctaatttttacattgggaataggagacataagtgtattttcaataaatccaccaaaatatttattttatttcaacattaagatgtaaaaagtcagagagagagaacagagtatgacagcgtcagtgagccgcccacctccctttggtgctccccaaagcctagcgcctgcagaaagctcctgccaccaccaggggcgacctgcatctccagagtgatggcaatttgtggctgtgggtgcagagcaggctggaagtgacagatggtggagaatcatccctacttccttataccttggtgggcaattatgagtctctcaggaggttccagcaggactgcacgctggtacctatggcaggagcccctggttaaccctctttgtgggcttttcctcacttccttgtctcacaatccctctctccagctgtggtttcttgggatcacctccagaatgaactacttaaacccaaacccttggctcaaggtgtactttgggggatgcaaaactaagacacagagagaaaaatgagaaaataatttagaaagaaagaatgaaggcaagaggagcattataactgatggcaaggaagacctggagggaaagagatgagattaagtaggggaaggaaaagaccagagatgaatgtcaggcttccatgaccaggaagcccctgtttactacctgccaacccaactcgtgccatctgccaaaccacacaccccaaaaacccatgcacctgcccccagatgttctcagatcccccgtccccactggcgttggtgagcactcaccccttgtcacctggtccaccagccaatgcagaggacagagtctagccccatggctccaactccccaacccaacacctccaggtcccaccttcctccaaaatcatgggtggggattttcggtcagacaactggccctgtgaggttagagaccccaagagtgtaagtacaataggaacctacactcttgataaagcccctggctgagacaaatctctttcccaagaacgtggtgttacaagagatgcaagagacaaattttaggaaacttgctgagaggctgagacccttttcagatgacaccaaaagctaactgcagccatgataagggattaccacccttgccataaaaccccactttggaccctctattctttgactttacaatgctttatataaatcctgcatcctcaatgggggcaatatcacccccaagggggcaaaaattgttcttaggatggagagccaaataatctcagatattatcgtggtttgtgaccctccaaagctcaaccctgcacaacaaaatcttatttcatttcatttcatggagaggggagatcagtaataataataataataataataataactaaaaagattccttagggtagtaataatgaaaaaaatctcaaaaaaacactgatataatgtgaaaatcctgttctggattcattttcaactcctcttaggaaataacatctaccgcaataagattttaacttctatctctcatctaatatcctgtggaaaacaaatatcacaaagtaatgcatggagagcagatgctttaaacatcacacgcgcttgccacagtaattgcactttgtaacttttctagcactttcataaattccagaagttatcttaatctccaatgctctgtagtgaggcaacagaagaaagatgatcattacttccaagtaaattctaagacttattaattgaatgactcatgctggatcacagaatgaagctctaaaaatgtcaacatttggagtcttgccctgtcccttcatcacctcgaatgcagctcccagcacacaatagggccttcagcaagattctgatgaacttccttaacttcaccatgttcaaatggaacccatttctgcccccaaacttattctgcttcccgaacccccagtgccaccagctacaacatcaccccctgaggtcccagacaacaatcttggggtatgtgtgatccagtcaatcaacataacaaagcagctaagagtccaggctacacccagcttccaaacccaatattgccacttaccaactatgaccccaggcaagctatttaacccccctgaaaaacagaaataacacctgccttccttgcaaggtaataatatggtttaaatgtggtgagacatattaaaatgcttagcacagtgccaggcacagagttggagctaaatagatggaactttccatgattgctcctgtcattgacattgggaatgcttttgctctgcagacttctaaaacagttgcacagtgtcagtgagaagactaacatggcagacagactgacaaaagtataatcccagctccataattcagtagagcagactcttcgcagaattcatttccctcatctataaaatgtgggcaacataacatctaccttgcaaggttgtggtgagtattaaatagataatgcacacagcagatgcccaacaaagagtgtggtgactgctgtggacttaattacaacctatctcaaattatcctacaattgtttctcacacagaatattgttttcaagtaccgggtcaatctggggtacaaaatatcaaagggacccctagtttccaaggtcctcttaccaagaagaaaagcaggcattgtgaggcaaacttagcccaggcctctgaggtctggaaacacatccagatggacaggggaaggtagagtgtaagcaaggtcatgggtaaagagcgtttaggctaggtctgtagtagaagcatactagaaacgcaaattttcaggccctacctcaaacctactgaatcagtaacaggggtctacaatctgcgtttacaaaccctttaggtgattctgacgcatgctaagtttgcaccattggtctatatatatggactccactgcttccagcttcatctctcccccacttccccagcccccttcatagggaccaatagctttaccgactccatgaagatcagtagttcattctcttctgatactcttttttttttctgagacagagtctcactctgtcacccaggctagagtgccatggcacaatctcagctcactgcaacctccacctcctgggttcgagtgtttctcatgcctcagcctccccagtagctgggtctacaggcacacaccaccatacctggctaatttttgtatttttagtagagacaaagtttcactatgttgcccaggctggctcaaattcctgagctcaggtaatccacacacctcagcctcccaaaatgctaggattaaaggtgtgagccaccgcacccagccttctctgctctttctcatggactcatcacataaaattcttcatgtttgcagcctctaaggaatgccaaagggcaaagtaaaaataaatactaaataagacagcatataatcatggctcatggcaggatttcaattatagttggttcccttctcctttgactcttggtgggagttcttcattcttgggtggttaagcaagtccaccctcagattaatacactcttcggcactccaggtgctagtttccactgtcaaggaatggtgtgcactgaagcccatcattcacaaggatgcaacaggttcagggggtgaggggcaggtgcctggggaggcagccccagacagactgtgcctggacaagccaaggctgccccagaccaaacaaaagatgaggcaacaaccaactgcagcagactggtgcagtaggaacagcatgaaccagaggtcaaagggtctctcctctggacccagacagctacctaacttctgggttcctctgcccaaaccacctgccctctctaagcctcttcagtaaaatcaatgtttagactgagtttcccaggagccctgtagccccatgcttttcagtgcaaatgttcagtaaaataacaaaaagaaagtaaagggttaatgctcctccatccagttttcttccagtttagaaagagacatatgtggccgggtgcagtggctcacacctgtaatgccagcactttgggaggccaaggtgggtggagcacctgaggtcaggagttcgaaccaacctggccaacatggtgaaaccccatctctactaaaaatacaaaaattagctgggcgtgatggcgggcacctgtaatctcagctactcgggaggctgaggcaggagaattgctggaacatgggaggcacaggttgcagtgagccgggatcgcgccattgcactccagcccaggctgacaacagcgagactccatctcaaaaaaagaaaaaaaaaaaaaaaaaaaaggaatgaaggaacaaaggaaagaaggaagggagggagggagggaggggagacagacgtatttgtgggaaagtaaacatttaattaaaattaagtaaaatatttttaactttctttttttttgaaacggagtttcgctcttgttgcctaggctagagtgcaatggcatgatcttcactcaccacaacctccgcctcccaggttcaagccatcctcccacctcagcctcccgagtagctgggaatacaggcatgcaccaccaggcccagctaattttgtatttttagtagagatggggtttctccatgttggtcaggctggtatagaactcccaatctcaggtgatccgcccgcctcggcctcccaaagtgctgggattacaggtgtgagccaccgcacctggccagtatttttaacttcttaaacatttttctaattgtttctacttaaacagatgaaagaatataaactgctttaaagaattttcaagtgaaatgaagatgccagatgacccaaaccctccaaacagagtcaaataaggaagaaaatagtctcggattgatatgcagctggggtgtgtggcagacagctagtcggctgaggatggacatttcatcttcccaactattcaccacctttagaaaagtttgctgaaagaaaaaggcagcaaggaaaagaagaaaaataagcattaacccattcacttgactaatatctcccataaagtaaagtggcaatacaacttgaagagtttcacatcctctggttgaaagaatgaaataaaatacaagacatcaccttccactgggctgagaaaatttagactaagtggtgtaaccgaaaaattaaaaacggcagtcattttacatcaagatcagcctcctggttaatgtctcaataggcagatggagtcagccacgttaacaggcactttgttctcagcttaaaggatcaatatcgcaattacacagtgccagcagaaattaaaacaggtttacacactagggtaatctaaacacaagaagaggaaaatcatcaggaactcggttcctgaacagagtccagaaaaacaatttaaaactcgtaacatagctgtgtgtgtgaagagggatgaggcgaagaaggtgtcaagtttggaaagaaatggcatctaaatctgacatgcttaatatttgcttaggtaatacctttaaaatgtcagagatcattagtgaattaatgttgggttattcttccgtgtagggaatcattcccaaagcacactgacttttggaataactgcaggcagggaaagctgaagaaatgggagtgaaaatgttgcatagtgtatttttcaaagatggttgcaacaatatctcccatctccatttcttctacaaggtgatcttgacactctcccatcaagtggtagagtctctctatccacctgaggatgggtgggtcttccgaccactttgaccagtaggatatggcagaagtcatgtgctggctccaggcatacctcttaactggcctggcatcttctgttttccacctcttggaactctagttttgaggatgttccctctcagaactcagctgccatactgtgagaagctgaagccacatggagaagctacttgtggacaatctggttgatagttccagctgcgtgccaagctgatgcccagtatcaactgccagcccagttgagcctttggaagacgccaatcccaatgctatccttccatattctcatcacagacctcagagaaggaagtgcccagctgagtccagtcaacccacagcaccatgagagataataatacattgttaagtcattatgttttgggcgatttgttatgcagcaatagagaactgaaacatgtgactcgagacagggttgggggcgggggcttgaggacagataagaaatctgcccctcaaaggtcttctgaatcagagttgcccttattttcttataaggacctcttcaaaaataaagcactccaaattccctagcatcgcacagaggcagggttggcgtgggggatagagggaggatgtatttgaagccaataatgtgaaaagcaaaataaacatctcaccacacataccattttaagggtgttaaaatcactgctctgagccacgcaatgggacaatcaaaataaaattttaaggtctgaaatttaaaaaaggcttcgaaaagatgcaaataaccttatcctctttaagtccctagtttaaagtaataagaaatgcattcacccaatgcattgccttcagcactaatctagaatgaagtcacttaaattctaagaccagaccccactaccccataataattggatggctgcatccaaggagttatctgagagctcaagcccttactgagttttcccattttctatttttttttccccgctttccctttctctgctgttttccttgctctccaggacacaataaagcaatggataggcggcaagtgctataatgcagtgattgcagtcatgtgagcaataatatcaggactgtatgggaaagggaccagacttcattataaataggaaaataataaagacagtagactgtggctggatgaacctcccacacatccaagtggatttagggctgagtcctcttgctgattgcttggatggaaactgggagtgcgtgcttttcgaaactctccagatacaaagatcacaaacacctccaagactcaggaaccacaggcacccaccaaaaccgggcctgatctcgactctgagcacttagttgtgagacctgacttcacttccagcctttagtccctcaagatttgatattcacactcagtatacatttttttcattttttacatctaatatttatttagctactcttgtgctaggggctgaggatatggtgacgaacaagtcagacatggtcccttccttcatttgagtgaacattcaagtggaaagacaagcaacaaccaagaaaaaggaaataaagactcaagatattatagacaatgataagccaatatagaaaaatatagggaacatgacagaagtggacaaggaagatcctgctgaaggggtagcatgtaagttaagacccaaagtgaggaaaggagttggagaaacagcactccaagcaaagagctaagtatgtgcaaaggtcctggggccaaaaagaaatttggcatgctctaggaatttttagggggaccagtgtaatagagtggggagagacaggagggagatgagtcaagaacagaggcaaaggtttgacacaaaatggtaaaaagcgttttatctcaggagcaatgggaagttattggagggtatcttaatcctttttgtgttgctgtaaaggaaaatctgagcttataaagaaaaattgtttacttgactcatgattttggatgcctggaaggttcaaaatagggcatctgtatcaggagaaggcctcaggctgcttccactcatgatggaaggtgaaggggagctggcatatgcagagatcacacagcaagaaagaaagcaagagagaaagtgaggaaatgccaggttctttttaatacccagagggaactaatagagtgacagcttctcaccctggagagaggcaattaatccattcatgagggatcacccataagttcccgatgacccaacacctcagaataggccctcctccaacactgtggatcaaatttccacatgggatttggtagagacaaattaaccatatccaaatgataggagagggttttaaggaggaaagtgactaaatctggctgatagttttaaacatcactccagagttaacagaggttacctttggggagaacagtaacagggaggggacagaggggggcttcctgggtaaagacgctatcctatttcttcatcagggcactgtgtacatgactggtttcagtttgttgacagtctgtcaagctgtatatttaagatatatgcccttttctgtatatatggttttttcagtaaaacgtttattaaaaatcactctggcttctcccaggaagtggggaggtagacagcttagttagaaaaccagtgtaggcactcggggtgagaagtgagggtggtttgagtggggctgggagcagaggaggagaaggcaaatggagaaagtcaagagacacctgtattttcatgtagttctgccttcacatgcagtgagcctcttttctgacctccactcttatgctagctccagggactcaagtaccatctcagtgacgaggcagcaccaactcgaatgaggtccaatgtgggtggggggagagaaactcagacaacaacaaatccatccaatatttatcatgcatctactacatctggaaatggctggaaaagaagaaaccagaggctaggaagggaaaggaaacatgagttatcgtgtggatagggtgatccaagggtaggggatagacaagcagcccaaggtgcaggttggcaggcacctgagaccctccgtgtagtctgggtacaagggggtccccacacaagctataggagtaagtctctgttcatactactgtgtctgatcactcctcaagaatggtcacataggctgggcacagtggctcacgcctgtaatccaagcactttgggaggccaaggagggcggatcacgaggtcaggagtttgagaccagcctggccaacaaagtgaaaccccgtctctgctaaaaaaaaaaatacaaaaattagccgggcgtggtggcacatgcctgtaatcctagctactcaggaggctgaggcaggagaacctcttgaacctgggaggtggaggttgcagtgagctgagatcgtgccactgcactctagcctgggggacagagcgagactccgtctcaggaaaaaaaaaaaaaaaaaaaaaaagaatggttacataatgggacttgtatatccactttagatcttctctaaggctctgggttctaggttctgttttaaagaacagaactgtttaaaggaaaaaaatatgatctggtgagaagtgaggtctcagaggcagagagctggagtcctcatttggaaaggaagaaaaaaaatggatccttaaagaaacttgtataatgggtgactcaaaattaatcaccttttgggaaacaggccatgttaattattcctggagtgggcaagtcagcttttgaaatgagctgccagtcatcagactttcatgtttagcagagccaaccacagcttttgtttaaaaattgaaagcccattcggatgtcatggtttagtgccaaggagggcatcatctcatcactaggcaggacatttaacatttccccagaagaaggcactcttctcacctcccgcccactccaggggagaattctccaatccacttgggtgggacatatcctcatatgtatacagcaatgcaacaaagaaacccaaattacctctattggtttagcaggaactagagccacacttagcagggtgctatccgaggaacagtgcattctattggcttatcaattacgtaacatctaacagctccttctcatcttttcagatttttatttgattggatagaaggcaaagtagttcaataaacacacacccaccctaaaagtcaaactcataaatctatccaactctaaagggtgccaaggactattgatgagggactgcattgtagaaatgggatcctctttgcttgtaaacaatggcatgggaaatttccatatgggataatgagacgtacctgctttcaaaaccagaggttgttcatttcattccattctattctgttgcatgttacgtaatataaagggcatctaagggtcaggaaactagatgaggaaataatgaaatttgagactatgtggaaagaaaggatggagtgaaaagaaaggaaggtaggaaaatggaagattgctttcaaagtaagatctttgtgcatttggaatgaaaataaaatcaatagggagtgcaaggaagttcctctggtttgaatgaatctgcccggcttcaaaaagttttacttcatgattgaatcgaaactcaaaagttgaacaaggaaattcaagcacgatttttattaaccccatatggcccagggagacttttaaaacagagacacttgctgctttctccagccctggatgttggggttttgcatgtaactcattcgtgatataaacgtatctcgtggggttttgcatgtaactcattcatgatataaacgtatctcctggggttttgcgtgtaactcattcatgatataaacgtatctcctggggttttgcatgtaactcattcatgatataaacgtgtctcctggggttttgcatgtaactcattcatgatataaacgtatctcctggggttttgcatgtaactcattcatgatataaacgtatctcctggggttttgcatgtaactcattcatgatataaacgtacctcctggggttttgcatgtaactcattcatgatataaacgtgtctccttcttttaattaactacttctctcatcaagggaaggggaaataatcccaatctaacaactcatccatgatgaactttgctgtctttcttctgtttccaaatgaatttggcttattaaaaaagtaatgagctattaattaactctacactcatacaaagctgtttaattctcaatctaattagccgcaatctgatgaaggattttaataattattttaactttgctaacagaaacatcttttcacttttcataagttatttatagaacagttcacattggatcctgcttggtttttaatttgatgacatttttattagatcctctactcttctaccatctctgtgtgacagagtttagaactgtcatcattgaaaagcccagaaatagtatcctgggtcacctacatggccaagacagtgcacccttctgtctttgaaaaaatctccaatggatgaggtatgggaggaccagaagccctgtccttctgatgtccttcttaaacaagaggcaaaactcaagtacgaaccaaggatagacttaaaactcccagtggaaagatcaaaggcttggggttactgctgaggctggatttggcagggagggaaggaaacatgccaccacacctataggaatgactttttcataactgatgcaaacaagggtattcccgaatctcttgtttaagaaacaacaggcagtgagttacatttcatttgtgtatagaatttctactggagccactacagtacaatgtgaaaagatcaaatgatattttatgtgcatggcctttatgatatgcatttctgcagacattagaaatttctatgtaaattacatattaatgtaaaggcctatgtacatcaaactatggattcaataaacacacttacacacatacacaaacttcacaaaaaataaaatgtgtttattcagaggcatttttattcttccctaggtattataagggaatagattatgttcagtgagccactctgcttctctaagatctaacatgagataagcctatttcacagttagtctcgccactttcctctaacacaggagggaacatgggagactgtttcctatgccacccccaagacttagtacatgaagaggctatatgtgtaatggtttagaaaacgaattctgaagccaactgcctgcgtacaaatctcagctccgcacttacttagctgtgtgcctttgggcaagtcaataacctttttgtaccccagttttctcatctaaaaaaaaatgggaatgaaatagtacctacctcacactcttgctaagaagattaaatgaattaatatatctaaagtccctggaataatgcagcacctactacatagtcggtaacttctaaataaaataaactctagctgggtacttctccctataaaatacatagagtttgagacactgcaaggccattatcctactaataacaatattttttaaaagctagaagctcatattatagagaacatttggccactgtagcatttcttataggcatttttttctgttgcttttttgagaaaacatagatatggtgctaaattaaatggcttacgttctgagccctcaccagtgttattatttattaaatgtcattattcattaaaatcctaataattcactaggtttttaaaaaattaaacacaggaccttgaaaaaattaaatttaaataagtaagttgaatattaatggagtgggaagcctaagggagtatgttctgaaaactagttatttatttattttaccaaaaaaagagctgtagttataaatagtattaataataacagtaataatagccagcatttattaagcattatccacattccaggcagtgtgctcagtgggttacatgcgccatttcattgcatatatagatgtgtgggaaggcattcatactggtggtcctctcctctctggattagctctctctcttatacttctttccccccaattacttatcccatgtagccagtactctgagaaggacatggcctcctccttcttgggaaaagatgcccaattccaatattcctgccctagaaggccccacaggagctgagaaggtgcctggaagacagcaggtaccaagcagatggatgaagcctggtttagaccttcagctggggagcaaggtcttcccatgagcctgtgtgtccagcatagttcatcaaggtcagagaacacacaggcatttaaatccaaagcccatcaagaaacgttctctgggagttctccactttgttcaagccccccagtcaaaaattctggtttcctttaatgataccccatcgatgataccacagagccatggttctcaaccaggggttattctgtccctcagtggacccttggcaatgtctggagacattttgggttgtcacagctgaggaagagaaaagtattaccagcatctagtgtatagagaccaggaatgctgctaaacatcccacagtacacagaacagcgcccacaacaaaaaactgccaaccaaaatgtcaattcaattaccaatttcagccaagaatatgaaacactgccgtggagtgacttagaaacagcacagcctttgggtccagacaccccgtccagggctctattacaagcagttgaatagccctgggcaactaacaatcaatcagtgagctctgcttttctcatctgcaaaccaggagcctgaggaagtcctctgaaaatccccttgcacagcactgcgaactcagcaaactgcagcaattatcaccatgactttgtcctcaaataaacctcgcaagccactgtggaatctccatttttctgtaggtgccaactctgggtactcactgaaaaccttacctttgggtaatgagttccaaaagacaaatctaattgatccttgcaggggactgaactcacaaccttggcctcattagcaccacatacgaatctactgagcaggacaaatgaagacacccaagaatcactttttcatgtaataacattcggcagctcactcaacacaatcaaagcacgtcaaacacaggatcagccctgcagaatcatgagtctcaaatgccgcatggaaccactgactctcagataccactgactctcagataccaccactggaaaagcagccatcacatcttaatggggattaaaaaccagaatacacaaggtggtgggggattaaatgagatcaggcaagcaaaacacccaagggctttgccttagacagtgttcaccagtgttattaccatcaatatcctgaaattaatgacacaacataggactacaccaaagcccaagagttatttatcagacatacctttgtgaaaataaataatagcaaaatagcaatgtcctttccacctgccttacttattcacataatgtctactcaggcttaaagacttagctcacacattatcacctataagaaatcctacctgatgagccctcaccccaggactggctgcccctctgtgtttcagtaactcactaggcttaccactatcaccactgctttcccactttattgtaattgtctctttttctttttccaccacaaatgtaggtacttctaatggtagggaatatatttttgttcatgtctacatttgcaacaggtgcacaggttagcacataccactactgaatatccatcaaatgtggactccatgtggttgaagcatggctgtattagatagctcttgcaacaaaaaaacactggcaccaagcccagtgacccaaaacaaaaacattcgtctgtgctcagatgtctgtatgttgtctggggtcaagctgaccagggtgtggcttagctgggcttaacttgggcttcaggttgggtccagatctgttccacatgactctcatcctccttggaccagtgaaccagccaatgtgtgtttctcatggcaatgaccaaaacacaaaaggggcaagcagagacatgcgctgcttcttacggcctgggtacagacacttccacctatattttattggcttaagcaagtcacgtgcttgacagcaactcaatgggtggtaaaaacatgctgcatctctactgggaataggtgtcaacttatgtggataaagggaggggtgaagaattggaaacagtaatctagtctaccatgagaatccttggatccaacgcagaaagctgcatttacacacttctagagtttgtgtatatttatggaatgtttatcccattccataatctgttatcaggagtcaacttctaaagccttcctccaatcttattttcctgttccaagcattagttttgaagtattttgaaagcagtgtgacatactcaaaagacttttgagtaggaggtgggggtcaggtgggtgggggacagccaagagccagcctggtgaactgagccatatctccaagctccatcctcatccacgcaccaaagggacagggtaacagaaactctcagacattctgtgatctgagtccaagggattgtggcccagaatcaacttcagaaaaacaagtgcactgtagcggcaagagtctcagagtcagtcctgcactcttacaccaaacacttccaaaacattcccagtgaagcttcaagttggacaatgccaggttttgctctgaaacacacacaacatagataggaagcaattcgctctcatttaaggtcaacctcactttttcccagggaagtctaaaaagattggtgtgtcaatcaaagtgtaaggcttaaatcttcttgttccttttgtaactagatagcatcgacattcagtagagtcaactcagccatacacagcttgggtctatcctctttcatggaaaaaaaattgtttttagaagtacaatgcacttacctttcatgagttcagaaataaatattttgtggttgatttgaaacagggatcagcaaaattcttctgtaaagggacatataataaacattttcagcttgtcgctgcagtgtgaaagcagctaccagctgtatgtaaacaaatgagcaaggctcatgaggtcgtgctccaatataactttagtcacaaaaacaggaggtggaatggattcagcccatgggccatattttgttgatccttgagctaaaagaatgagtaaatatttgcctaatgttctagaacattggtccatacctccaagaagcccaagaaaatgtacaaaattcaggtcatttttttggcagagtctgatttaaggaatgcctctgaacacctggtacttcatttaatcctcctcacgggtcgatgaaataggaaaatatattcccattttttgttttttgaatgagtctcactctgtcacccaggctggagtgtacagtggctcgatcttggctcactgcaacctccgcctcccaggttcaagtgattctcctgcctcagcctcctgagcagctgtgactacaggcacacgccaccatgcccggctaatttttgtatttttagtagagacggggtttcaccgtgttggtcaggatggtcttggtctcctgacctcgtgatccacccgcctcaacctcccaaagtgctgggattacaggcgtgagccaccgcacctggccatatattcccattttataaacgaagatactaaggtttctgaacttagtgatccacccaagatcacacagctagtacatggtaaagctgggattccaaccaaatcctgtgtaaatgttggttcagtagttttcaagaatcataatagatgttatcattacgcaccctgagcctaaaatggttacaaagaatgaccagaaaatgctaattttattctaagaaagtcaacagtgatgaattcaaatttatgagtaagctgttcattaaagccctttttacaatagtaaaatattgcaacaatctaaatatccaatattaaagggacgcttgagcaaattacaatataacctttgaaaataatgttcataagaatatgtaatgatattggaaatgttcgccataatgttgtttttcaaaaaactagaaaacaacacagtggcaaaggcatgactctgttgttttagcccttatattaaatgtataaaaagctctggaagaagacaccttgtttatcatcatttagctcctggtttggggacggcaagtagttttatttttattctttgaactcttggttttgccaaactgtgttcaatatacataaaattctataatctgataagtatgtctttaaaatgcaatttatccttgttttctattttttcttctattgttctattttattcattcttttcttataagtaagttgtccataagtgaacacttcaaaagcaacaattccatcccctggattcaaggaagaatcctatgcataatccttcacatgcatcatgacccagattatactggtgtttagaagggtgaagcagtggtcctttgagtgttcagacccagttcccaaggagcacagatacacctgaatcccatcttgggttgcaagccctgttgagtaaaaagaaaccttctggtttcaacattcatcctttttatgattattgccaaaaaatttttaacaaacattaatataatgcataacatcccagtaccacttgtgatgtgtttaataaattctgtgtggtttttacatagccctgagaggtaagcaatgagtcaggagtttcctccaagcacctgttaagtggcatcatataaatagcaatgtcaggaaatcaggtaccagaagaaccaggcttgagtctccagcaaggccacatgggagctgactgaccctggttaagtccctgaaaccctcgggcttagcaactttattcttttggtttttgttgttggtttttgtttcagtggtgtgatcatagctcactgtagcctcatactcctgggctcaagctttcctcccaacttggcctcccatagtgctgggattataggtgtgagataccagacccgtccagcaccctgattcttaaaccaggagtagtaaccacactttcaacacccacaatagaattacgaggatctaatgaaaatcacaaactatatcaaatatataaagggtgttctgccatgatggccaattataatactgggagtgcttcctgtccctaccacttccagatccagtttttttttttttaaatggagtctcactctgttgcccaggctggagtgcagtggcgcgacctcggctcactgcaagctccgcctcccgggttcaccccattctcctgcctcagtctcccgagtagctgggactacaggtgcccgccaccacgtccggctaattgtttgtatttttagtagagacggggtttcaccatgttagccaggatggtctcgatctcctgacctcgtgatccgcccgcctcggtctcccaaagtgctgggattgcaggcgtgagccaccacacccggcccagattcagatttttaaaaaacattgttatcttggaaattggttatctacttctgtactggaggaagacagtgtgtgcatgttgctgcacgtgtgtgtgtccatagatccttgtttcattcagctgtgcagcaacaggggtcaagtctacatgaaaacgactgacatattcttccagccactgccagtcttactgcttccttcaatcaagctttttggttttccataaacatttttcatgttttgcataggtattttaagtaaatttttgtattgaaattttgtattaatatatgtaaatatacatacagaaaaatgtacaaatcacaaatagattgctgagtaaattttcacaaacacacttcgataactgccagccaggtcaagaaataacatgctaccaacatcgcagaagctcccttcattgttctttccagtccacatctcccggctccttctcccaggataattgctgtcttgacttctatcactgtagatgagtattgcctgtttttgaaatgctcattaatggtatcatacgctatgttgttacctgtgtctggcacttttatacccaaagttgactgagattcacccatttcattgcaagaagtagttcattattcattatctttgctggatggtatttctttgcataaaatatatcacaatttatccattctactatgggctttggggttgtttccagtctttggttcttacaaatgctgctgagaacatttgtgtacatgcccatgagtaaatatgtttacccacttcggctagctatacctctaagaatgagataatgcttcataaattatgcatatatctagcttattagatctgccaaatttatccttccagtagcgatgtatgagagtttcagttgctccacatccttaccaacacaggcattttgtctgtatcagttaatgaatctggtggatgcatactgaaatatcagtgtagtttttatttgcatttcctggtgactaatgagattcagcacctgtgcatatgcttagtgtccatttgaatatcctccctggtaaaatgcctcttcacatctcttgatacaatgctttctttttttagagacaattcttgatttattcatgccaagacaagaaggagtggcagagaaaataaaaaataataggtgtttcgaaaaaatattttaaatttgtctttggattttggttttgatgctaaacttgagtaggaatttccttgaatttttcaaattcataataatgccatccatagagaagctagaaaaatactaatgaaagctgtcatttaccgagtcatctcacataaagtgttctatgaggacactgaggttcagagaggttgaataacttgcccaacactgaacagctactaagtggctgaaccaaaattcaaactctgtctggggactccaaaacccaggctcttgatcacctagctattcctcagcattataggattctagtccccggcttcagcatgctttagaatccccgggaggatcccatcctcagggttcctgattcagtagggctgcggttaggcctgggaatttgcatttctaacaagttcccaggtgattcccaggatgccagcccagggaccacactatgaaaaccactgttctgaaaggtggcaatcaggtctcacttatctctgtatccaaaggccccagtccagtgcctggcaggtatcagacatataaatgattgattactaaatgattcctactccctcttggtcctctgtctggcacacagagccatgccgctgtgacagctgtcagctaatgtgagtgaaacccctctcagtcctagaaaggcctgtccacaaacatgaagagagcaagaaactccacttatgatacggtttgggtgtttgtcccttccaaatctcatgttgaaatgtgattcccagtgttggaggtgggtcccagtgggagatgattggatcatgggggcagatcccttatgtatggtttagcgccatccacttgttaacgagtgagtgctcgctcagttagttcatccaagatctggttgttttaaaagtgccttgggcctcccccttctctctctcttgctcccattctcaccatgtgatacactggctccccattcaccttccaacatgattgtatgcttcctgaggtcctcgcaaaagtagatgttggcaccatgcttcctgtacagcctgtataactgtgagccaaattaaacctcttttctttatacattacacaggcccaggttttgttttgttttgtttgttgttgttgttgtttttgagatggagtttcggtcttgttgcccaggctggagtgcaatggtgcaatctcggctcactgcagcctccacctcctgtgttcaagcaattctcctgcctcagcctcccaagtaaactgggattacaggtgtgagccaccacacctggctaattttgtatttttagtagagatggggtttcatcatgttggtcaggctggtcacaaactcctgacctcaggtgatccacccaccttggcctcccaaagtgctgggattacaggcgtgagccactgcacccggccccctggtatttctttatggcagcacaaaaatggcctaatacaacttatttcttccactttcttttaaacaagaggtggataaatcaacacaaggggaagagtaaaactgttccctggcctggttgactgcatttgagcaaacatgcccatgacctatctcacttgaaacactttccacactaggtcttttagaatgcatgttgtggcagaaactgtcagtcatctcctcgaatctactctttcctttcttattgagtgacaagcaccatgactactttctgagccataagatacaagcagagttagatcttccagggagtcctcttaaaagagagagaacacgcccttttctatgtcttcctgctgctagaactcaagtagccaccttgggccatgaggttcagggccacaacccctctgaatggtagatgagaaaactggaaagagcctgggaccctttcaactgtaaagtgccacaagaccagctgcattgcctcttctgtgacaagttttacaagaggcagaaatcaatttttatcttgtttaaactactgttaatttgaaacttctctttaatgcagctggacattatcctaactagtacctacaggcactatgacccagctgaaagaccaccagatgagatttagccttcctcttttgtagtatatcttaaggcaagtcacttcagttcctgaggctcggtttccccatctgtaaaaaaggaagaaaaatgtgtgttgccattgattcgaaaggcttttgtgagacacaaatattaccttgttcagacatgctttatgaaatacagagccctatgaaattgtgaaggacttttatttccgacaaacaaaggaatttttaaaagagaaaatgaagtaggacaaggccttttataagaagtcttttctaattaaggagaaaggactgaactggaccaacagcttctctgctcatctctgccaagtctcctctcccaattccatccaggtcattctttattttccaaatgggaatttaattttgctctaacaccattattacatccaaattaaatatttattgggctgactatcaattgacttttagaaataaagatttgaaatttatgagctaacagagtaattcgataattgtaaatttcacaaccgagctttgtaatcaattactgtttagtaatgatataaatgcatgttcttctcaggagaccccagtcaactataaattagattctgcacacataacaatctggcaacatctccacactggctttgtctcttctcgggaggaaccaaggccaggaaataatcccgggctggctttccctggctgtgcatttggaccccagttcacccatcagtcaggctgtgctgagactagacttaatgagtagtcacacaaaacataattcagaagataaatcacctgcacataaaacctcacaatccaactcaaagagacgctgtacaatgggtaggtaacagagacaatctttcacgcattcaacgatccaacagatagctactgagtgcctactatgtgccaggcacctttctacatccgtgtagaaaacaaagatacagtcaccctcctagaggatgagaatagggtgcaatgaaccataaacaatacatgacagaaataagcaaattacactgggctgactttaggaaataaagatttgaagttcatgagcaaacgtggagtgtgaaaagactggagtgttagaaagtcataaatgctatggaaagaaacagatttttgagataagcattgtcctaattttatgaataaggaaattagagctcaaagatcaaacttagaaactaagttagatttgggaaattttttttttttttgagacagaatatcactcttattgcccaggctggagtgcaatggcacaatctcagctcactgcaacctccacctcccaggttcaagctattctcctgccccaacctcccaagtagctgggattacaggcatgtgccgccacacctagctgattttttttttttttttaagtagaaatgaggtttcatcatgttggtcaggctggtctcaaactcctgatctcaagtgatccacccacctcggcctcccaaagtgctgggattacagttgtcagccaccgtgctgggccagatttgggatttgaactctgaccttcctggtgccaaattccaccctctttctaccacccacactgaatgaatgaatacctgtacacaagcacttttgacctcatttctcactgactgcacaatagaaaaatccctgttaataagctccccccatgtaagagactctcaaactcagaaaataaagctaagactaaagaaatgctctatagctagactggacgttagcatctataagcatccaacttgcttaaatctagacttggcttgagcaaaacttgtattttaattttgatgtgataaatgctagcattattttcactatgaaaaaatgttcaagcaattgtgtgtattactgttcatttgaaacccattctttgtctttgcaggactggccaactataagagaatgcattctaaattgagtttctattagaagtaagcatggtcaaaggggattctgaagccctcagggagacctctgtcataatccacagattctggtaattgattagagagcttttaagtgaacttgctgattacattttgaattcttttatattaattattaaaggcgaattatgttgttgaaaaggaaagccacagaaagatggtaatttaatcaaataggttagagaggcattctggataaggtaattgattttaaaagtgaaaggcatttgggagaaggtttgtcaaaaatggatttaaacaactgaaaactgtgtacccaatcactgtttgtgtattgcttaaagatgaaaagaaaggaccgggtgtggtggctcatccctttaatcccagcactttgggaggctgtgaggcaggcagatcacctgaagtcaggagtttaagaccagcctgaccaacatggtgaaaccccgtctctataaaaacacaaaaaatagccgggcatgatggtgggtgcctgtaatcccagctacttgggaggctgaggcaggagaatcgcttgaacctgggagatggaggttgcagtgagccaacatcacgccattgcactctagcctgggcaacagagcaagacttcgtttcaaagagaaaaaaaaaagaaagaaaaaaaaaagattaaaagaaagtcattgagaatttggtaggacctgtccaaataagaagaaaaggaagttttgttatacttgtaaaatgcacttgcccactgttatagtcaatgcctgactgaacaatccctgcactgctatctctttataattttcagtggatgagttcacacaagaaaagatttcacctgaactctgtagttttcttcaactgtcccttttcaacaaagatgctaagacttcccaaagatacaaaaagatgttacaaaggtcagagcccaggcttgaaaattactatattatttaaagattgaaaaataaaattttgttctcttgagaatgacaccaccccctccagccccaatatccctttcagtctctcctcaggagacgaggccaccttgtgatagtaatagtaatagtggtagcaggaagagcaggaacactgcacagagtggtggtgcttcccaggagtagtaaacatccatagagtgcttcttctcaacctgggtcccagaatcatcccttgaaggacatctgcccagaagcaacatcgaaacggaatcaactgcattggattctgcgtgaacaagaaatagacttacgattattatttccaattcttcttttcattgccacaggaaatggaaataaggcaagggtgaaatatttgtggggtagatttacttatgattgtaagctatttttcccttctttggattcctcctaatccctaaacaagaaaaaaaatgcaactctaaacatggcggccgggcgcggtggctcacacctgtaatcccagcactttgggaggcaaaggcgggcggatcacaaggtcaggagatggagaccatcctggctaacatggtgaaaccctatctctactaaaaatacaaaaaattagccgggcgtggtggtgggcacctgtagtcccagctactcgggaggctgaggcaggagaatggcgtgaacctgggaggcgaagcttgtagtgagccgagatcttgccactgcactcctgcctgggcaacagagcgagactccatctcaaaaaaaaaaaaaaaaatagctaatcagaaaacacagccaggaaacatcaccaccctaatgcacctgctaacattaataagagccagagaagcccggaggttcaataactcccagcaagctccttggccatcctctagccatgttcctgcagccacaaacaccagccagaaaaggagatgcaacagaaagcccaggccatcacactgaggcacaactcagtgcagacgcagcttcttatggccaacctgggcccagagggatgttaaagagcccaggttggtgagtcatggacatgtccttctccacctgggcattccaaagagaaactctttttggaaggaatttgcaaaaagaaaagtaggagggtatagtttctacaataagagagcctagggccttgctgtttctgatggtgggtgaagcccattccttccatgctagacttaggctaacctctacctttcacttggttttgatgcatggcattttgattgagcgattttcccaattttcttcccatagctgcaaatctggatacttggagatactgctagttctttgatggtgacaactgccatggaataataagagcttaacaaaaagctactctttccatagtagcggttatggctttgattggagtgatactccaaccatgagcatgggaaggcagggttagttagatgtaacttacaggaagaagacaaagatacccactgtaagagtggtgagaagcagagcaagtctgcatgaagtaaacatgttagaggcagatgaagccagcccaaggcccccatttggacaactgggagatgttcagttgaacacttacggacataaaaaaggacaaacagatacaaagaaacgtcagaaaatttttaataagggaagatgaataaatgaccaattgttgactgatctgcactcagtcttgtcttggaccaattgctacatctatcctatctcatattacaaaacgcagaactctgaaaggttcaagtccctacgacaaataagcaatttgttgctcttgacagtcttggagttaccaacccattcttttggcctgccccagcacaaccactatgggggccccaaaatagtcaggtgaaaaggacagaaggcagaacagcacttccactgggtaggtcaccaaatgagaaagttccagcaatgagaagaggtttcctaatatcaagaagggatgcagagatgcaccagtctccccattattaccactgctcctggccgaatggacttgggctttaggactacagaggtgccaaacccttggcttcactggccttcagcacatttgaaagacaacaaaaaatcagacagcaggctaccagctgttagcccactctgtctggctgggtttcaaagttaggaggtcatctgtatccttctcccacagctgcccacactgtaagctgagggaagatgccccaagtcattctcaaactatacctatcacccttcatcacaattttaaagttatatttattcgtacatataaagttatacacacatatatgtatacagtacatgcatgcgtgtgtatatatgttttctatccatctggcctacaaagctataagctccttgaaggtcctgcatgagggtcctgcttgttttcttgttgtattcactctcatctagccctaaccctcaccaggtcattcataaattagttcagttaatgactggacctttagttttagagcctgactctgcccaagggggtgtagggggcatagaggccgaggtataaatggcttccccagcatttcaagtaggctctaaccatcactgtaagaggaaggaggcagagtcctgatcccatatgtcaggaccaccgcctgtgatccttcacagtgtgccctgcaaaggagcaccaagccacgaggacaagagtcgaattgacaggcccctctccccacatttagctaccaggggctgcatccgtgaagagggagtacttttttccagtttgtgcacatcgcgtggctagtgagctctgcctgccacaccctttctgagcccacaatttttatactctgatgaaaaaagtgactgatgtgtgatcctctgtcaagttcctctcttccccttcttaccaaacagaacgctgcctttagactcagctgctcctccagctccactcccctccccgactccaaagagttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcccaaagagttcttttcgggagattttgtaacacagaatcaagaattcacagagagacctagaactaaagaggcaggagacacaaggaaagaatttaagccaaaacaactaagttgatctacgtaacaaaaactatacaagtgggtaagagcaggaagaaaaaaagaaaagaatgttgtgaaaatatatatttggattcccattgatagtcttgatgatgtgagtggataagtgaatgccctcttcatttgtttgtgctcctaaaacacaaccgtcattcagagactgaaccacatgggtttatgggtttataagtgttatcttttattgagatggaaggaggcaaatcccagaaaattagacagacactggggaaaagtagaaaacactggaacatattgtcttttcccttaccccaccccctacccccagaataaagtgcaccaggtaggagcagaaataaaaagaagccaatatttattggtaccccctggtaccaattcaaggggaactgtttaaaggccaaacccatgacctacacaacagccacaggattcaagagaacattcacctaccacactcacgaacaatgcaattgcctcgtttctcaataaacatgacttctgaatagattcaatcctgttcacagaagaataaagaaaaaaaggaacttattttttacatattgaaaaaaaattggggtggagaactgcatgaagataccctgcaggtatatgcctctgaaaataatctacagaatccagaagaaaatttcaaaaatctgttcgtcatgctgaaaaagaggccaagggctctgagagtcagtgcagagagtcactgggagacataaggcaaacacgaaaatgtaacaagatttggtgaaataaggaaggattttcaaaaaaaaaaaaaaaggaaaaagtatgtatggtactaaaagcaatatctttttaaaaaatcaatgaaacggaataaagctcagaaacaagccaaagtataacaagatcaagtcttcagcaactggtgcagagacagctggctaagcatctaaatacaaatgaagccaggatctccacctgacgcctacaacagtttgaccatgtgtcaccagtctgcacctatcaggacgcaggtagaaacacattaacagtagcaattcaataacactggcttctgtcctattgctgatttagcacctccagcctctaacaagtactcccaagtatgcctgggcatccccaggaggtgtttcatacaaccacacatgcatccaccctccacagcttcccatcagacttggtccccacaccactgtgctgagccctgacacagcttcagggaagcacaggtgtcctcggatccttccaaggacaagcttcaaagtcattcatgccaaaattgggaatcacacctccactcttgtccctgctgggtaattccagggcagatctgctttttcccagtatgcaacagacattagtaaaatgactttcatgctgttttcacgttttggaactttcaaatgtttctgtaataatgatatattatttctataataatttgaaaaatctgacttgacagaaaataaaacagaattttcctcgaccaaatttgtttttaaaaagttacttacttactttctatttcttttaagtatcctctgtcttgtcaaagaattattcctcaaagaaacattcaggcctagatggattcataggtgatttattcagacaagcttttatttttcaaacaaagccagcataatactgataccagcatttgacaaagaccaggaaaaaagagctcaaaatcaagtaacttatgaacataaacaaaaatcctaattaagcacttagcaaatagaaattagaaaaacattttttaaaataacgcatcatgctttaataagattcatcccccaaacacaggctatcaaaataaacaccatattagtaaattaaagagtaaacattttatagtaaacttaatagataccaaaaaagcatatactcattcctcatctatgcctgagctaataagaaaaaaaacacatcttgataaaatagaactcttgcttaactcaatgaaaaatttacacacacacacacacacagtcacaaccatgccacaaaataatcagcacagtacttaagggaaaaatgctagaagtgttcccattagagaaaggaaaaaagcaagaatgcccattatcaccattgttactgaacattgtactctgagtgctattcaatgcaattagataagaacaaaataatataatgaaaaagagatagtaaaactatctttacatgtagatccttgtatatttgaagaagaaccaactaaaaagcttatagaaaaactaagatttcagtaggtggattttaaaaaaacataagaaatcaattgctttttaagccaagaatagaaaaaatggaaaaagatatttctcaaaagagtaaaaacaaaactaaatatttaggaatgaattttacaaaatcacccgtaaccctggagggttttatcagaggacaaaaaggaactactgaattcagtgaatatgttgttcttggatactctgtaatatccaatgttgtgatactgcagacgtaatcccaatcaaaagtctcaatttatgaaccttgacaatatgactccaaagttcatctggaagaataaacacagcatgaagaatcagaaaaatctaaaaatatgattattttaaggatttgaggagacttctcctgtaaagagtaaaacataatgctgtaatgcaggaagagacaaggaaatataaccgaataaaataaccaaactagacacaggccaatatggaaatttaatataagctagaagaggtatttcaaatctgtaaggggaatagagagaatacaatagatgatgttaggacaacttgatagttatttgcaaaacttggataaaagatttaaaagctttatatatagtttatatgatataatatgacatataattatatatgagtaaaggaaaaggtaaagtgttttatcatcttggattggataatgcggttcttaacgtgaaaccaagttgagaaaccaataactactttgattacataaaaaataaactgggcagaaagagatagcataaatagtttaaatacaggtgcttgcctggggaagaggggcggacatcaactgaaagggagctcaatggggggttctggaaatgttctatatcttaatctagatggtggtttcgtaggtgtatacatgtgtaaaattcgctgagctgtacagttaagatttgtgcatttatcatgcataaactattcctcagtaaaaaagaaaaaataataaagaaaataaatcatgcatttatacttcctttcccataaagactacatttcagggtaagaaagacttcggactgagggaaaattcttcttcatgcaagttacagctaagaaagacaaaagggatgaaagaaatagaaactcgttattttgcaattcctactgaagtaatctggacaatgtcaatggttgttaaaagcattagagtgctggccgggcacggtggctcacgcctgtaatcccagcattttgggaggccgaggcaggcggatcacgaggtcaggagattgagaccatcctggctaacacacagtgaaacctcgtctctactaaaaatacaaaacattagccgggcatggtggcaggcgccttgtagtcccagctacccgggaggctgaggcaggagaatggcgtgaacctgggaggtggagcttgcagtgagccaagatcccaccactgcactccagcctgggcaacagagcgagactctgtctcaaaaaaaaaaaaaaaaaatagtattggagtgctggttctgaaacgctagcctgcatcagtgtcagagggtttgctaaaacacaaattgctggctcccactcacagagtttctgattcagtagacctggtgggggcctgggaactggcatttctcacaagttcccaggtgataggtgataatggtgctgctggtccaggcactacactttgaaaactcctgcattagaaaaaagactgatgttgaaatttataatgggtaaatcaggctgaaaacacctgaacttacggatcagtctgagcttcgattccacgggacatggaggaacagagggacatgataaacaccaccataaagatatagtcagccaaatccagtatgggaaatctacagaacaaataacccagagtctccaacaaataaacacaacaaagaaaaggaagggggagccgttatagatcagtttaatttatttagaagtgaaaagacaaatttagatactgacaaagattctttgcttggccaaactttagtcaggcttctgaaccttttccttggcccatctgtgtacttccttgtaaaatccagctgaagaaagagtgctgctaggtcagtttagcaagaacttcccacctttgctctctgatctccctcacttgaaatctgaagtttctcgtcctccatcaccctggcgtgtcttcaggaagagtcctcttaggtcagtttagccagaattccccttacccctcatgtttcttcctggtaattttctatccactgatccccaccctgctccttggctataaatctcctcttgcccatgctgtattcggagttgagcccaagctctctccccaactgcaagaccccattgcagtagtccctatacccatcatgatggccctgaataaaatctgtcttactatgctttaacaagtatcactgaatttttttcttctttaacagggctgattcaaactagctacctattttctaattgggaggttaaagaaaatttggtggtattaatgaattgttgtcagttttgttgtctgtgataatagaatgctgtttatcctttttgacatcctgatctgttagactaagggtttattaacctcagcactgttgacatttggggccagacaattctttgacgtagaggactatccaatgccttgtagggcacgtaccagcatccctggcctcaacctgttcacgccagtagcacccaccgccaccattcccagctgcaaccacccaaactgtctccagataatatcaaatgtcccctggggagggagtgcaaaactgcccccagttgagaaccactgagttaggtatatcttctggaggatttgcaagtgaagggttatgtctggggttttttgtgttttaaaatactccagagaaaagcaatggggagtgagagtaaatgagatgcagctagaaaggcacgatgctgccaactgtcgaagtggggttcagagtgtacctgggtgtcgttagtctattctctgtgttttaatatatgtttgaacacttcttaagaaaagtgtttacaaaaacgtgaacacacataaaatcatgctgtagaaacatgtttctgacagatgttcatgatagtatgtggggaaaaaaaggaacagatcatgcaatatgtacgcggtgaccccgtttggatataaaagagacacagagagaaactcagaagagagatgagtcaaaatattcacattgatggtctcctggtggttagaattgtgggtaataattttcctcttccagtctgtagttttcaaagctctccatgtgaacatttacctcctattcaatgtagacaaacaaataaaataaaaactaacaaagaataaagggactgttacaaagaaacacactgttggttgggaaagaaacagaaagatccttcaaagcaaacacaagatcttacaaagtacaacaataagagaccactgagtgtagtgaccaagatatcacacagcccttaaggaaatgctgcattaaagaatgcaagttcattgacagtgtattggaggcggtggggggctttcgtctttcctgattctgaccttgaggcatctgaattccacttgatctcccctgtttcagaaggcagagtcacatggaataaattttagaatgccttctctctaaacagagaatggtgtttttcctgccaggcaaatgtttaaactaaaatttttaaaataatcacttggtgcttaaatccacagcaaagtggaaatagtcagctattaagctagtctcatgcctcaaaggttctgggcaactggagttttgctcttctgcttttcaaagccaaatataaattatctgctatttaatcacctgttgctatggctcacctgagcagctgcagcccggctttagcacaagtaattaatggcgagccagaatacccagttttatgaatcattctgtagcatctggcctaaatgtcagtttcctttccatcttaaactttcccatagtctgctgtaaattcatctccgccttcactagaacatggaacccataaagaaatttgcatgttgcctccttcaatgctgtagctttactgcctagaagaaagcccagcacatagtaggtgctcaataaatgcttgctaaataaatgactgaatcatgttttccgcccctttcttgatttctggccttccaagaaaagaacaaatgttctaataaatacgaaaatttattatttctaaggctaccaaatggcctgaattatcagcttccttagactccagtaacatgctgcttacctgtatttttggtgagtgaatgaaggtattaacacagacctatctacccccatactacacacatgcacagtacatgtgcaacacacacacacacagagcactctgcaacaccctcagacacctccacacccttggacctaatgatacgtgtattttctgtttactccctgtgcctcagctagtaagcgcttgatctcattgtcttcctaataaaatgaattaattttcagagttaaaattcatgaggcagcatatgtaaagtctgtgtctataactgcttctgaattccctccagctgcggacatttttattctgcccacaaaggctcccgagtttatttgaagacgtttctttgtggccttccccagggtccccagcagcccacagtgggttttgctgctacttccagacatttcctgtcaattcactccagtgtttggcaggagaactaatgccagattctagaatccaggctaactttaagctaacaatctccttccattcccgtctcctggtcttctacctgtgactactcaggtcccccagaatgtcactccaaatccttcctaaccaacccttagacatctagtccaacctcctcctgaggagaagggaaaactggggcccagaagggtgaggcagcatgttatgggtacatggtaagtgagaagcaatgcagggacaatgacagaggtctcctgacccccaagatgtcagtgttctttctccagagcaagaatcagcaatttacagcctgtgggccagatctggccctctgcctttttttgtaaataaagttttatttgaacacagccatgcctactaatttccatactgcctgtggctatttggggctataacaacaggactgagtagttgtgacacaggccatacgaactgcaagccttaaatatttgctatcttactagttgcagaaaaagttagctactccttctagaagggtcaaaagaacaggaagatggatgggaaagggctgacacaaacaccccatggaaaaccaactgagcctctggctgttctcctcacaggaggccggctccacaggggaatgggaagatcctctggggcggcaccaaccatttccctgactcctcttcccccaacgctatagtggcctctctcctttgcagagactgcagccctatctgctggcaggcaccttaggctgaccctgccaacacatgcacacatgcactcagacacacacacgcgcgtacacacacacatgcacacgcaagctgagttccaagtgtgacatggctgccataaatcagcctggaatattaaactcaagctgccatgaaagagcctctcaactccacagcacacagaagaccaagaggtatgggacccatcttcagggaggaagccttttgcagttcaattcacttccccgggttcaagttttgtctaccaccctcgccagctgggtaacctggtgttacctaatttctcagcccgtggctcctcatcaataaaccaaagctgacctctgttgtgaggattcactgaagtgatgcttgcagagctccaagcatagggcccggcacagagtgagtgctgagtgggcactggcaagaggctctctagggattgcccgggctctctggacaatgcaaggcatgattctagtgtccagaacagcctctgacacacagggtctgaaacagccttctttattccaaaagctcagaaacccaaagctaaaagccaaccgagtaggccagagccaggaggcccaggccgccctgtttggctggaacacccgggctgccggcgtggctcggagccagcactgcaggcaggcagccttgacttcctccttcccagtcctgatagacatgagccatgcgaccctgggcaggccaccctgtctccatgagcctcagtttcctcatctgtcacatgataacagcatttaccccacagggttactgtgaggactgagtgaaacaaaatacccgaggacctttgtaccgggcacaggtgggcccctccataagtgagtcactgccactgtcatgtaacacggtaatagttcagcctgggaatgtcttccacagtctgaccacagaaccccctcacctgtgacggggtcactcgcatctccgcccactctacccggggattcagtctaagtggagcctccctcttacccttcccagcctagcctcacgccccaccagtcccctgccacagccacacatacctggaaggccacaccttgccactgaccctgttcccacatcaaatgattttgtcaacatgaaaccaaaccacaaccaggtggatgcagagcctctgtcacactcagtccttgctcctcagtttccttcctgtgtgaccatgggagagtcattcaccctctctgggcacaaactcaatcatttgtaaagaacaggcttcagatcagatattcaagttccttccaccttgagaaacactgcagagattctactatgaagccctaatgaagacgccccatgtaactggctaactccaatgtcaatttccacccaaatgcatccacttaatctaatagagaccgcatggtacaggcaagaagtgttgctttgctaacaagaccactaaaggcctcagctggagactgtgactttatcaatcgtcctggcctcctccctgtcttgtgctcagtctcttttgcacgtgtcttctccccactcgattgttgttaaatcttgatttttttctgttttcgcttacatggaaccatggggcttttccagctctcctccatactccctgtgccttcactctctgtggcttcttggtcagtttgatttttcctgaattagaattaaaggccttggagaagctccgagcagtgcaagtcctgggagaccacgttccaggacaccagaccttgtttagtattgcccatcgcagtgtgaacactctaacaacaaagaacttgccacccgcagtggcagtccaccccatgttcacagcattctgaggctggaaaattctaattttctaatggcccgtccctcgacagcaacagaaggcagtgtccgagggtcccctggagccaagccagacactgggctattgatttacctatgagggagggaggtgttcttcctctcccaagtgtaaagtatctaaggtggcccaagctggaaaacggtcaccccaggcctagaacgcacattagagccccaagttggtgttcccaatggctctgccacgtggggccctttctcctccttctccagggatttagaagtggagcagcatcggcatctgggcctcattgcagaatgaggggacaaaaggcttcttgtacgataaggagacaaaagcctccaagggacttaccacaaaacagaagcaatattttaaatgctttttagaacatttgcatgaagataatccagaagtacagtgaaaaagaaatacaaaagatttgcaatgaaatctccttcctgtttctgaccacaggccacccaggccccttccccagcgtttattacaatcagtttcttgcatttcctctcagtgataatttatgcaaaaaactacatgtatttaaatatgtgtgtgtgcatatccttttgttttacaactgataaaccagaagacaaaattctgtacctcgcttttttcaattcatcgatcttggatattgttccattaatgcttagagaactggtgctttctctttaatggtatttcacagcatggacatttgcctcatgtctagccttttgcaagtatgagtaaagctgcaataaacatcccagtacatacatttcctgcacatgaacacacacacacacaaaatcagataaaattcctagaaatagaactacttttagatggacaagagttagcaaacctctgggtagtgtgtgtgtgtgtgtgtgtgtgtgtgtgtgtgtgtgtgtgtgtgtgtgtgtacatacatgcacgtgtgtgtaagtacatgcatgtgtgtgcatgtagtgtaaagtggttttgggtttttttaattaatacaatgggctgagatcttctagttgtagagtattagagctaaattggagctcatcctatttcacttcatctgcttttctttgagtctgttgttcctcaatttcatccacacttttggttattaatgcccccattcagtgtttcagattcaccagggcttcttaagccagtttacttttttgagacttaatgcccttacagagccactgtgtgtgaaattatcttttacaatgctgaatccaagcagtttatagttttcagtcaattactcccaaccaccagagctgtgctcaggataacatttctggctaaatttcttacttcttggatcatgaattctcagacactactaatcctggtgtctggtgagtcaacatattcggactcacactcaggccaaagactctctccaaacttagaaatccacattcaataagccacatgtgcactggaaaattgtagcacaaatgccaggctgataatctcgataatatttcacagtccctgataaagagctaacttttaagaaatcctgaagcaaaatcatttataattttttaaatttccgtggctaacaaaaaacaaatcactggtcattaattcaaccatgtcagttagctctggctgtataacaagctacccccaacattcagtggcttcaaatcgccaccacttatttaccttatgattctgtgggtcaatgctctgagctaggcccagtcgggcagctcttctgctggtcgtggcgaggctcagttatgcatctgtgatcagcagctgctcagcaaggtggctctgcttctagggatggctggttatcagctggggtgactggggcaaccgggccatgtatgtcaacatccagcaggctgatctgggcttcttcacatggaggtgtcagcagggaccccaggaatagcaagtaaacaagccccagacacaagtccctttcaaacctcaggcagtgtcacatttgctactctcccattggccaaaacgagccacgtgtccaagcccagattcaaagggtagagaaatagactctacctcttcatgggaaaatgtacagtgttgcattgcaagggtatggacagatggtaaggggaagaattaatggccatttttacatttatcacatcaacagtgtataaattcatcaaacctaaatagtatttgtataagacttcgcaataaatagaacagctctcaattactctctttattcccagaacagtttcttgaaacaggatccacataaaagcaacacctggagagacttctagtgcccgtggttgagtatccacagaaccattccaagccatcctacaagttagcattcaggcacccttgatcagatgtggtgagcctccgagcagctttccttaagaccacagacacacagaagaaaaagcatgcgacgtggagtacagaagactcaagtctaacctcaactctcaaagcaaattacttcagctcttctacatgccatctgctccctcatttgccagcaggaacagcaggaacaatctaagaattgctaagaggactcaaaggaatcatcctatatgcccatgccctaggcacctggaagtgcctggaacagcacagcaaagaccttgaaacagtgaatcatgcccaacgttctaaacggacttgaatgctcaaataaaaatgacagatgtgagcaggaggctccaaggaaagacaaggttgtgagccagcacacagaagtgggagacagaaccagcctggccacagggcacacgactgtcccccgggcaggatttgaaagttgaagatggcagaactgcatgttctctgtaccctctgtggaagcagccaggtcttggatctgcacaaaacattctctcccctcaaagaagagtgagtcccaggcatgtctttcctggggaaacagccctgcctgacctaagaaaggcatgtgaatctatagggccctattaagggcctgaagaatcgtgctgcttgctgtctacagaaggaaaaaaccatcccccatcacatatatttcaaggtaaataacaagagctatagctacaatttgttgaacagccatatggcagaacctgttccagtcaacccacctacattaaataattagcattcatgctgcaattatctacccaaagacaactgtgtgcctatggtgtaccagattccacccaaggggcaggagaagccgtgttgacatggccataccaggcatggtaactgcccagtggagtcttacagtctggtcacaatcattaatgctacagatgctgcctctaccaacagaaagagagcacttaacttttatgaatgagcatgagcactgcatgctggactttgcacacattatttcagtgactctccacaattacccttgaagtaagcatcatcatctccaccttacaaataagtgaactgaggcccagagaacttgtctaacagcaacaggcagcatggggctgagctggattcaaaccgggggcaccttccaagagaccctgccctgccacggctcctcttctccccataaggaacggtgttgatgagcaggacaatgttcaggggtggtgatcagaagcctccctcctcttcaccctgggttactcccaacaatccccctacctgatcttcctgaaactcttagacaaaggtaagtggtgcccatttctgctatccctctccctcctcccttcaactttccagagtcttcagcaaattgatctaataaaaattcaacagctcactggctctaaatctcaggtctggttttttaactgcctaaagggctcacagggttgctaactcggcccttgaataaaatctaaaacttacacacttgtgcattcattcattcaacaaaaacttaccaagtgcccaccaaatgccaagcccagcatgacagcacctaggtaatactgaagaggtttacacaggtaaggctgggcaccacacatttacagaggccacattttttaggtctgagggacttttctctagcagtatctagccacctgataaaagggaagaaaagagaaagagctgtgtttgtccaggtgttaaggttgagatagagatctaaggaaagggtactgggattccaaaaaagagaatggtggatatgatatctatggaatccaagctgatctgggaagcaagtagacacagaaagaggcagacagacagcagaatcaaccaagggaccttgcttgatgtgggcacttccatcaaaaatggccattcaactggagcaaacaagaccagaccaggatggtgtctagagttcacataagcagcaatcccacctaacgcatgagtgccttctatagggtcacaaggtgctgctacatctggtaacaggaaactctccaccttccaaggaacccattgccaagtgagcatctgcctgctgggacttttgggttctggttcttccatccacagctacatagagcaagggtccaggatggggcaccatacttccagtgcaaccaggctgccctcggcccttctcaatgcacagatatccatccacttccacgattcagtgatcaactttgtgccaatggctccaaggtctaaaatttcagcctctatccaagcttcagactcaaatactcaactgctcaccagacaccctgaccacaacatccctgagcactcacactctgaatgcatgcaaacctgagctcgtggccttgtccccatatacccaaacactgcattggaggatggatcctacccaattcccaactgggcaccatccttgatctctcttcccaaaacacacaaataatcaccttcctattcattcttcctcctaacaggttctcagatacagccacctaatcccttctatccccactgcaatgactcccaacaaggtcaccaacatctctctcctggcattattatctttctcagggaagttttcctaactagtcttacttctaccaccttacccactctatccattttcctggcatggaatcaaaagtgatgtatgagtcaatttttatgaaatgtccagaataggcaaatccatagcgacagaaaggaggttaacggttgcctggggctggaggtagggtgatacagggaatgatgctaatgggtacctggtttcttttgggggtggtgaaaacgttctaaaatggattgtgatgatgattgcacaactctgaatatactaaaaaccgttgaattaaaaaaaaaagtgatgttttcaaaaagaaaagttggtcacaacacatcactgcttaaaatttataagcagcttccactgctctgggaatgcagtcatcagttacccccaggatctgcaggatctgaccattcaccccactggcctcacctctgatgctacagcatacctgtcaactctgtgctccagccacattgggcattttgttcccacaacatgccatgctggctcacctctgagccacagcaaaggctgttccctctgcctcacccctaccctctgcttctaatgaaacactagacttctcctctcatggtatctcctgctgttttgtaattttctgcccatttatctgtctccttccaaaatgtctgatcaacaaggaaacatgtctatgttgttcaccaatgtctccctagtcctgacacataggaagccctcaataatctactttatttatgtatttatttacttatttctttatttattgactagaataaagtagattattgaaggtttcctatatgtgtaatcctttcatctactccaagcttgttgaaagaaagcaagaatttccaactatcaatcaccttcactgatctgtttcctatatctctattaatgcagccccaaatggcataggcttcttaagttgccacaattcacttcagatgcacacataatttccccttgactgaagaactcaaggatttttctattacatactgttaaaccatctcatacccaagcaattctccaatttaaatacttgctgcaggagtttcttatcaagacagaaagaaggaaagcccattttcaggatgaaaaagagaatgtgaacactttcagcttccatttttatctggttcagccctggctcacagattaatttctggcaccaggatctgggaccagataacagagaatcacacagaagagccttctccagctctccaaagccagcaagaatcactcttttcacaatcgtccattttacaatgtgtctaattataactgaataaattacttctgccattctgcagaaatacttaaaataaatagctctctttccttgaattaaaatcatagtcttttgttcactgttttctgttccataaagcaacagagtctgttgattaaagatcatttataggacttcgttttcaatcttttttatgatatcactttaaaatacccccaaatattcagctgcaaggagggataagaactactggaaattggctctttgagagtttttgatgagaaatgaagtcgtggatgtaactctcagcgaatgagcatatattagaaaagtcgattttaataactacttggttcttcttcttggactttttttctctacccaacttcctacatttttcttgagattacaacataatccccactgacacactaaatattacctctctgtattgaatggatgacgctgagacaataaatcactttgagctaacacaatatgccaaccagtcccagctaagccaaatatttgacgaaagacatacaaactgaaatttagcaaggcaggaatgctttggggattatgtcctgaatatcaaccatctctagaccctatgtagtgaaaaaaatagatgttcaaggaggccatatgtgaatgcataagatgattctgtgttcagaataaccacagttagccaattccaggagatatcttgggatgagattgtgattaggccactctccaaacactagtggatgtcacgacaaaataaagactcttcacttctgaaccaaaaaaaaaaaaaatcaccccaaaacacataaactattgttcttctgcagtggtgtagaaacaaacatgatgttgatgaaaaagactgtctgggggtactgagcatgccactagggaagctgacacctcgggtcctctcacttgcatgggcccctttcaaagcccggtgctaatttggtatctgaaatgctgtcttctttttcttaaagtgggcccctgaattgtgcacacttccacaaaaccttccagagctgcccctgtggaccctactttagaaggattgaaatgggactccagagatgccctcagctgtcaatacgatggaactatattcacaggtcatcctaagtcccctaaaaggaagacagagcatctctggccagcagccaaggccttcccagggcagctccagtgaacttctctgactcccatctcactcgcccaacctgccttccactgaagcatcagtgatcactaaccagcttcatccactgtcatgtttcactagagctgggacctcagccaagcatgttctacctcatgtcttctctccaggtacctctgctcctccttcagaacctactcgaggggcatcagctctaagaaacctgtcttggtgcccccttcccccaagatgaaactgtgtcctcctatgtgccctgcagcttggagcttagtaccttccctgggtctgaaatgtggctccctcacttactagaaacctcccatgcctcagtttcctcatcagcaaaatggaaagcaacagtactcccctcataaaatggacacgaggataatccttgttgcacagtagaaactcaataaacgccaaccatcatcatcatcatcctacacatcgcttcgtcagaaatccctcaacaactcattctacctcccccatcagaccagggacttctcaatagcagagatggaagcccctgtgcccagagcctggtgctccataaatgtttgctgagcacatgaaggaattaagtaatatttatattatgaccaacagaggtaaaattcaataacacatcccacagcctcttgtttgctaacatttcaagtctatattggagaatttgatgaaaagcataagaagacagaacagggagcaaaacagctctgcatcatgtttctctgtctattcccaagagcatcccttcttcatcatgggccaacagagcccagagctgctagctgtctacaaaacccatctcccaagggcagcttcattcatcgacctctctttgcagacagacttccaaggtgccttcggctgaaaaattctttcatctactccaagccaaagcaggatcacagaacctggcactctcacccagaaatcaccacacacaccatttgacccatctagattcttcctatcaggttagaaaacatgaataactctatagccatgatgagactttaaatctacccaagacctcttcaagcaaagcaagggctctgtctgtggaagctgcaataggtgtcatggaagtgtacacgtgcaatctacacagagcattgacatttccataccctgggctggttgggtggggggatctgcctccatgtttaacctcatcttggccacaccctcacacctgcccttcactcccaactccacaaaatcaatctgcatatcctcatattaaatatatgcttcaattgttcacatgtcactgtcctagcacatttgtcactctgcctggaacggttctcaccaaccctccatcgcatccctggggcaagaagtatccatctcaataatgtctccctactcctttcaaccccatccccaacttttgaggcctcctggacccctcttcttcagactcccctagttcttgccccatgattctctcagcactgttgttgtatgtctctcatccaccatatgttatctctgcaaccccagcacccagcacagcaatggatgcacacagcatgtgctctgtgaatacctgatgaatgaatgattccacgagaaatctcccctgagatcacagacttaaattatgctccacataattcctgagtttcttaaaagaagaggtgttcccatccagtgggtcattgctcattaaccccaaaaccatcccagctatttttatagagggagtaaagaatatgtgggttgatttttcaggaagaaatttcccatagcagaaccactctgaaggctgaggtgtagcactggtatagggttcatatgcctcaaaaatgtactgtctgctaccttttttcataggcaagaaaaataaagccgcagaagtgaagaaataagatgggctttactctcacctccaagattgcaaaacatcagtagtatctgctcaagaaatctttaacgtgcttgaggtaggtcagagatgttgttttttaaaatgtctgtgtgatcctcttacttctgcaagacaaattaatgctgcagaataactgggggaaagaaaaaaatctagatccatgttctgttggaatgcagcttgctctaattgttttctcatgtaattacatatattaccaatataattacaaataatacacatatttgatttgtgcaattatagaatagtatataatttttaaatgtggtatgtttctttctacccaagatccctttgtgaagaaaatgatttatcatttctaaaaatatgcccctgtgcattatgttttaataaagcaaaaattagtaaatatttgcctttcttttatatttcaacaaaataaactttgtcatgaaaattcaagttttaaaaggctcattatatgctttgaaaaactgcttgcactaggttaattctattcactggagaaaagccaaccaaatactatgattctcaagaaaggtaattataacagacaatgtataaggcacagtcaagggaggtatttgagaaggcctgggataggaggaaataacacctcaatgaatgggtgaggaacagcctatttaagagtgaaagagacaagtgagaaaactgggctgtgtcccttatcagttgtgtgtctttgagcaagcaactgaacctctcagaactttcatgaagtggaggtaatttaccacctcactcattgtacagttgtgaaaattaaatgaggtaacatgtgtgaaaggccctagcactttctcacttagcaaccatgcatgtcacgtggtagatggttcctgccgtaacagcataaatcataaccctcatctaccattactgtatttctctttgcaagatgacagttcaccagatctgctgcacagcatctggaacaccgtggtctctaagtctccctttttggaaggtaaaatggcaacagcctgcattcattcaaagaggagacttgtgaagggtccagggaagaaacgtgtgaacatccgtgagatgtgaagggaaatgcagaatattaaactgtaaagaccagaaaagaatttccagataatcctcatctgactagtgactcacactgaggttctattggatccacgcaatagaatctttgtttaaaaacttagccaacatttaaaattaggagatttcccataaaaccttggaagtacacattctcattctgcaatgagaagcctgggtaaggctgggcccaagatcctctatggcagcaaccggctggagccaaggagtttgctccctaggtagccacactcgaaaggctgccctctccagtgttcattatttgcataagctatggcaccctgagacaaaaaataaataacactctcaagtcgatcaacagacaactcagaactgaccagtaaaggataacggtctccatccccacctaatactcagccagctgctgaagcctcctgtttctggggccaactttgctttcccagcagctataatcacaacggttgtcacgacttccacagggtcttttctttttcttttttttggagattgagtctcgctctgtcgcccaggctggagtacagtggcaccatttcagctcactgcaacctccacctcccaggttcaagtgattctcgtgcttcagcctcccagatagctgggacaacaggcacgtgtcaccatgcccagctaatttttgtatttttggtagaaatggggtttcaccatgttggccaggctggtcttgaactcttggcctcaagcaatctgccctcctcggcttcccaaagtgctgggattacaggcatgagccactgtgtccggccttccacagggtcttcaaatgcccaaagctcactccgcactggggagaaaggtgaccctaggagaaaactgttacagagttggtacaatggagtgtcctgcctacctagagatgaaggcagatgtgatctgccttcatgctgaacctcacatttaagaagagaataaatggatcacagtgcatctgagatgtcctgaagactccatctaaatattcaagaatatgtatctaatcttagcacttcagtgtggtaaaaaatggcatagactggtcgggtgtggtggctcacgcctgtaatcccagcactttgggaggcctaggagggcagatcacctgaggtcaggagttcaagaccagcctaaccaacatggagaaaccccatctctactaaaaatacaaaattagccaggcatggtggcttgtgcctgtaatcccagctactagggaggctgaggcaggagaattgcttgaacccgggaggcggaggttgcggtgagctgagatcgtgccattgcacattgcactccaacctgggcaacaggagcaaaactccgtctcaaacaaaaaaaaaaaaaaaaaaggcatggactccatggcataggaacagaaagcttctaataaagagagttaataaagaggtgggggtgggggaataccaactttcctggcaagaaaactgagtcttggaaagttttagtaattcatctgagaactagaaactgaatccaggaactgactccagatatgaataaacaaaccatgtagccttacttttctagttacttccctccataggtacatcaaaattaagaaaccaagaacttggccaggtgtggtggctcacatctgcaatcccagcacttcagaaggctgaggcaggaggatcacctgaggtcaggagtttgagaccagcctgaccaacatggagaaaccccgtctctactaaacatacaaaaaattagccaggcatggtggcacatatctgtaatcccagctactcaggaggctgaggtaggagtatcacttgaacccgggaggcagaggttgcagtgagccaagattgtgccattgcactccagcccaggcaacaagagcgaaactccgtctcaaaaaaaaaaaaagaaaccaagaacttgaagactaatgagactgatgagatacaactctcaactctcctgaagatggagaagaaggctgagctcaggaagccctcctgataaagccatctatatttttgagccagcaatagtataaagaatttggagcttctttttactgcaacatctggatgaagctttttaaatatttcattcgggattcattcctcgtcatggaaacaactatttcatcaaataccagaactgctcagaaaaagcctctgtctcatattcaagttgaaccacaggctcaaagactaagtaaataagtgtacaactaccttgaaaagttagccaagaaaaaaaaaatggaaggaaatatgccagaatattaaagtggttaactgtgtagtaggaacacaaacagatatcatttttgcttctgtctttttcccctagtatctttgttttctcaaatgggcttgtattacttgtttaaaataatctataactagacaagaaaaaaatacatatgaattcattgcacacaagtgatggagctgagtcaggcgtcttgtcctgatctggacccacagatctatctcagtgtagcttagcccatttttgccttctctgccccctgctagactacgtgaggtctccccaatgccttgccatccccactgtgtgccccaatctgagcagcaaggtcctcagcacatagtagctacctaataaacatttataaagtgaataaattcatagcatcttgtatttcctttcacacattcttcctctggacctgtcaatgtagaggatgatactcaggtgaatgatatttcctggaagatactatacaattaattacccttgtaacctcaaaaatcatatttgaaatcaaatctgcacaagtgacaagtaaaggatataaaacatggcattctccttagcctcttaattacatactatatatcaagcttctcccaagctctgaaaatgtcccatttaacattctacacttggcattcaattgcaaaacctgaaatggagattgtattacttaaatacttcccaattttttttttacctacttgttctacatttttacccttcaaccaggttttatctactccctgtttccctcttatgctgttgtatgctagccaagaaaatttagggtaacactcaattgtttaaatccagatacttccattgtcctaagaccaaggggcatttacctagtgcaaaacacatgagtgagtgggcaaaggcatgttgaaggcacacaacagaatcatccctctgaccatcctctccatgaagctaatatcttgagatacatagtggacaccaatatatatagtatgaatgaaactttgtttaaaaagtatgcatgtgtacaaacacagatatgttaatatatccataggaaaaagtcagaaaggatacacacagaatagcaaataataattagctttgcatgaggtgaagtggaaaagccagtgggctaaggaggtagaaatttttacttattttccataatctagataaataaggcaaaggaactataaatgaattgttcttatgtttacccttttattccaaataaaaaagtactaaaatggtatgtaagtgagtgtgttatctgtataaaggttagttccctgccttcaggagaaaaacacagtataaaataattccagaactcacattatacattattacaaccacagagacaaagaggactctccggatacataaatatatacccatcctatctcctcaaacaaatggaaatcagattcagacaacatggcctcaagaaagtctcaataaaggtcgcatgctaccatgccactatttgggtatttggttctgtttatgggaggagttctgtaaaaagattagcgcaatcggtcaatgtaactgcagtgggattgaatttccacagaggctggcaacaagctcagcacagagaaggcaagaggatgaataaattatagcaagaacatgaggttcataaccaggaaagaggagcgaatgaagccagcctctcagaatcaggtggcttgtagagaaacctctagagatggctccatccctctccccaaaaaaagaactgctgcaagttccttgcaggtgagaagatactccaattctatatcttcacgtcttggggaaggaaacacccaagtagtaaatccattaatactgtccttacaggtgaggtattcctgaaaactgcttaattccccataaaagcataaaattgttttcttctaatcatttcatcattttgggacttatatttaagtctttaatccattttcagttgatttttgtacacggtgagagataaggatctaatttcattcttctgcatatggatatccactttcccgaataccatttactggcaagactgtcctttccccattgtgtgctcttggcacttttgttgaaaatccattggctgtaaatgcatggatttatttatgggttctctattctcttccattggtttatgtgtctatttaatgccagtaccatgctgctttagttactacagctatgtacagtattttgaagtcaggtagtgtgatgcctccagctttgttatttttgttcaagattgctttggctattcagggacttttgtgattccaaacaaattttaggagtgttttttctatttctgtgaagatcatcattggtattttcatagggattacactgaatctttagattgctttgggtagtataaaactactagaagaaaacataggagaaaagctccatgacattggtctgggcagtgatttttttggatatgacctcaaaagcaaatggaattgcatcgaactaaaaagcttctgcatggcaaaggaaacaatcaacagactgaagagacaactcacagaataagagaaaatatctgcaaactgtacatctgataaggggttaatattcaaactatataagaagttcaagcaattatatagcaaggaaataacctgattttaaaatgagcaaaagactcgaatagacattgatccaaaaaaaaagacatacaaatggccaacgggtatatgaaaaaatgctcagcatcactaatcatcagggaaatgcaaattacaactacaacgagatatcatctcactccgttagaatggctttcatcaaaatgacgaaagagaagtgttagagaggatgtggagaagatagaacccttatacactgttggtggaaatgtaaattagtacagacattatgaaaaacagtatggaggttcctcaaaatattaaaaatagaactgccatatgatccagcaatctcacttctgggtatatatccaaaggaaataaaatcaatatgttgaagagatatctgcattcccatgttagccaagatacaaaatcaatctaaatgtccatcagtggatgaatggataaagaaaatgtggtaaatatacacaatggaataccattcagccatatcaaggatgaagccctgtcacttgcaacaatgtggataaacctggaggacattatgtcaagcaaaataagccaggcacagaaagacaaacactgcatgatctcactcatatgtggaatctaaaaaaaagttgatctcatagaagtagacagtagaatgatggtacgattggctgggatggttagcagggagaggatgggggatggtggccaaaagatacatcattacagttaggagagaaataacttcaagagatctattgcacagcatggtgactctagttaatgatgataaattgtattcttgaaaaatgcaaacagggtggatgttgtgctctcaccacaaaaatgataactttgtgaagtaatgcatttgttaattagctagatttaaccattctgcaatgtctatatatgtcaaaacatcatgttgtacatgataaaaacatacaattttttctgtcgatttaaaaaaagaaataaaacattaaaataaatttttttaatgtaaattggtttctcactcttcagaaattagcagcctgagccctcaccacaagacttccacatatgtgaagggagccaagtcgcttgttcagttcctctctttttaaaaataatccctgttctcagtattcctccctgggagcactttgaaatctgtccatcattttatctgggcatttttacacactattcacgacacctccaagcaacattgaacttccctgaaattgagaaaggcatggggagtgctgggtgggtccttgtgctgggaggaaccttgtttgggggcttctctctttgctcctggtgttggaaagatgaaaggccttatttcctgatcagcactggggacaggaaccacagatcaagtggacaagctccacctgcatcaggcatggaggcttgtccataacagaacctcagaattaggagctacagcatcagaggggccttagcaacatccattttacagatgagaaaactgagacccaaaaaagggagcgggtgcctgtggtttcctgggaagttaatgacagaaggagactggaatctagggctctgagctcaaagagctaaaatgactgatgaatggagagatggacagatgcctggatggcacagagacagacagactcaggggatgactaattggcatcttggtataaaatgatgaatgaggagaaagtcttctcccaaggctgtgttggcccatggttccaaaacctgtcctgagaccccaccccaccatcttaaaatttcctgccatggtttacaatggacaaagagagtgaatggttggatcaaacccaatgctgacttggatggaggagggaggattaaagcctacatactctttatacagcaagagtgccaggatctcatcagttcctcttcagtcattgatcatccaatggaaaaatttgctacagctacactggagtgtctgagatcattgagagacaccagccacaagggcttccctgcctggcttgcagtgagagctctttgttgaacattttgagattcaaggaggggtacacccacattaatcagctccttggtcagggttcaggcagagatggtagctggatgtgatgcatcagttgtcagaagccttctgccccttcatccatgcattcaacacctacttgctgaatccctatcacatgccactgttttaagccattgggacacagcaattaaaaaaaaagacacaggctgggcacggtggctcactcctatcatcccagcactttgggaggccaaggcgggaggatcgcttgagcccaggagtttgagaccaggctgggcaacatggcaaaacactgtctctctactaaaaatacaaaaaaaaaaaatagccaggcatggtggtacacacctgtagtcccagctacttggggagggggtggaggcaggaggatcacttgagcctgagaggtcaaggctgtggtgagtcctgatgatgccactgcactctagcctgggtggcagagtgagaccgtgtctcaaacaaacaaaagatacaaatccctgccctcttggatttacatcttactggggatgggaagcagaaacagacaattacgagaaatataataaagtacactgtaaaggtagaaccttaactgactccctctgcaagccaacccatagctgattatggtgggagggagtgggcactttgcagtattaaactaagtagttggtgggggaaggagactcactaattttcccaggacagtcactcctggcttattccagttgtagaccaattaatgtcaattagtttcttttagtgctacctttgtatctcaaaagtgtcctggtttggatggcaagttatatatcggtcatcttattgagaagtatgctttcagactccaaggaggcaagggagttagccaagcaggtatcctagggaagaacaagtagagcaaagactccaaggtgggagtgtgcctgatgtgttcaaggaaaagcaactgggcccagaggctggagcatgcatgggttacagggactaaatagtcatgggcccttccaagttttccaacaaaaactgtggttttgctgagtgagatggaggaatttgggtgagttctgagcagaggagggacatgatccaattctgatttgcagtgagcctttctggctgccatcttgagagtagattctgtcaagacaaggcagaagaaggaagactgattaggaagcccttctaataatcccaggggaaaagagggtggcttggccaggtggctcgcaagtggaggtggcgagagtggggggactctggatgtagtttgaagacaacacattggacttgctgatggattcgatgttggtatgggacatagagaggaatcaagaaagactagggcaacttggccagggcaagtggacgtgtgcagttgccattgactgacatgaggaagtctgagggtggagctggtttggagaattaggagttcaattctggacaagttccatgtgagatgaatgttagacatataagtggaaatgccacgcagttaaatattggaggcaagagctctggagagggttctgtactggagatacaaattcgggagtcattagcatggagaaggtctttaatgcaatatttaccaacaaagaacatctggcctttagtccaattcaaagcagcacaaattatatggtagttgcctatcatttcatctcccccattctgttcgtgctcccatcaaaacttcctatgaccccaaactacacagccagacctcactccagggcctgagcagtcagagctgcaaggcaccccaaggggtacaagcacttcctgaaacaattctactctataacaatactggtactcaccaaggacaccttgtgtaaaataggaagccagttgtggggagcagtgaacatggagtcagaaaatctagaagaagaatcttggctctaccaatggtttgactctagctgtgtgaccttgggcaagtcactcaaactctctgtgctcagctctctcacatggtttatattgtgcagtaagtgacaaaatccatctcaacagcttagcacagcacctgggacatagtaaccgctcagtaaaaatcagcaaaatgactgttttgttgccattattattagcatttgacttaagatgaggataagggaacaaatcatttatttggaaggtaatcctagggggcactggttaaggagaggccaagtgataaagagaaagaaagaagccagtgaagggtgtgttctcaagccagttatcgctgtcagcaaatagagctgaactccaccagggcaccctgacatccagtgtagagtacacaccccagagttctcccacctgaggggtgagggagctgaggtatttatacaccaactcccaccaaccatgccatgagagctgggggtggatactactttctagctttggagaaagagatgcaattggaagtcggctggtgcatactgcagtggtaaggcccaaaggatgtggacagggcacacactggcacctgctgcagagtcatcattgcctatctggggcaattcacccagcttctctgagcctcagttttccatctataaaatggcaggcatcatatctgcttctcagagttggcatgaggatttcagaaaataatgtttgtcaaagcacctggcgtgatgcctgccacatggaatttcaatttcctttctccctttctcttctcctcattacgccctttccacatgaagggaaaacttacttgctcacaagccacacagaaaatgcctttcagaagggcactttgtgttttacaacattgttctctggctgcagagcactccttccatataatatactctcagatgtccataatgatcttgctaagtattcctttctggaaggaggaagtagaggtgctttgatagtgaggacggaggtttgtgcccccaaggtatgcttcatgtctgtggtcgctgtttttcgccccgaccatgtcaaggccccctatctccaaacaaattggtcaagatggagtcattcctaatctgatgacatccagcactgccatgtggtgtaagctgctgagctgctaacagagacactggtaagttgacccagaaaggagtcaatcccttcttacttccccctgcaaaaaaaaaaaaaagaaagaaaaagaaaaagaccaactcaaaaggcccctgcaggaaacaggcctgcccggtgcaacccaccagcccatacagcagaacagacgtgggcccaggagacaagtgcttatgtgtgagcaagaagccaccagaataccaacgagcagggaggtctccatgccaggaaacccccacaacggctatttgtttggtgtcctgggaaaactgagcaccaactgaggcctcacggaggcatccaacagccggaataaatctgaaagaagttgaccacgctgagacggaccaggcttggttactgacacacaaataagtccagttgattaataactactctctgtttagagttagcaacggtcccaaagactggcatcttgctgcatccaaagaggtgcttgctggcatggataaggcaataagaataaataaaattaagtggtttctttacacaggactttgctaagaatctcacatatggcatcttgttgatttttcttggcagccccaacacaaacatgatcatctccattttactggtaaaagaagcctgaagctcaaagggcttatcaataatttgatcatggtgatataaagccagtcaacaggtaagcctacacttacccacccatgaagtcagccttgaaagaatattttttttttaatctacagtgttttcatatacaagatctaatggaaaacaaagtgtatttattatgtttagaagccagaatagtggttaacattgaggtgaaatgaggggtaacacccaggaaggtgccagtataagggactttaagatattggccctgtactgcttcctggccttggtggtggtttcacgaaactcaccttgtgatagcaattcaccaaggtggacacttagtaaccagtgaattttctttaaaaaaaaaaaaaacgtagagacaaggtctggctatcttgcccaggttggtctcaaactcctggcctcaagtgatccttccacctcagccttccgaagtgctgggattacagccatgagccactgtgtccagccaactagtgaattttctatacttacattatactaatggaaggatgagaaaatcacggccagagggggccagctgtctgtttttgtaaataaagttttcctggagcagagccatttctgtgtcgatgtattgcctgtgattaataatccgatcctctgcagaaaaattttgctgatttctgtgtacactgttcagaacttggtttgagcacacattatatctagctttctgcttgcgtttttcgtaggcaaacatgtaaatgagtttgcagacttgaagaacacaacaaatgacatgaaggagaaagagctctatgttaccctgacacattcattaaagaagttatacggtcattaataaaaacacagatgatccaatgagaatgtaaataaggaaattaggataaactgaagaaaattaagagcaaagagaaagacaggtataacagaaatcatcttacttaaaattactaagatttggctgcaactttgactcagagtttcatggatacccaagcaaaattggtaagacactcaacccagacgctccaaatgccaaggaaccaagcagagcttcaaacttcctctccagaatccacagagcatccaagcctgtgcacacaactgaaagctggctgttcctgatttttttttaaaagcaccttttccccatttttcctgcaaaaaagcaactcattttttgctctgatgggcaaaaaaaccctcaggagcctaacttttgccaactgccatgtggcactgcccattcccatctgggctggctggcacagaccacagcgagcagaacagagggcccaggagggtcctcagatcgtggctacatcacaatgacctacttgggattagaacaacattttagagcataacagcgttttatgggtcataaatattgcacagatgttccttatttacacagactcgatagattattattgcaacattaccatgctaatatggtgattcctgttttcgaaactggcgggcaagaagcagggaaatgtaattaaacaagtatggtgcacattttaggaggttgttcagtaaaacaaaataaaaacacacactaaaactgctacctcttattcaattttattccacaactgactctcgatggcaagagttaaacttttcacaaaatagcattagctgggattggagaataataacttaaataacagcaatggcagtaacaaacagctagcattgaatgtgtgcttactacgtgttttatacatgcattaactcacttaatgctcagaacaaccttataacgcggatcttataactatgcccctttgacaaataaggaaactgaggcagaggtggccaagcaatttcccagagtcagaaatcttttctcagtggaaccagcatctgacttcaaagtccatgttctggtaataaccacacaacaagcaaagacttactgacagctttctgcaaaagcaaaggctactccgtgcggtcccatcctgggccactaaagcacacaacgatcaatgccccaacacataacatcacctctttgaagacaaagaatggaaggtcggtctccatggtccatcactctggaggcagcaaggagtcaagcttccaggatctggtctggggctgcctggctccccttcccttcagccacaccagtcagtcacccatggttccaaccacaccaaagggtttggcttttcatgatgacccgctggacagcagcttggctcaggctgctcttctgtctgctccccatctcactactcatagccaagcatcatttcctgccagaaaccatccctggctccagccaagtgaggctgctccttgcagcagcgtcttacacctaccatctccgtatggtgatagccaacatgcccatctgtctccccaaaccagacggtgagctccttgaggacagaaatgatctttcaggtatcccttgctggtgaatccacagtgaccaacccagagaaggaactcagcaaaatggtgaaccagaagaactggctaggaagagagcggagatagctgcaaggatgccctgctaggaactgtggcaatccttacaaaagtttgccctgaaacaatcagcatcctcttagcaatttttgagtctccaaaataaacatctgtggtcaacaatgaaatgcacagagtgctcactttttgacagtccgttctataacacaaatcttgcttggaggccagccacattcacccttaatcctaggtgtgatcacatgaaagtgttcacgtggtccacgcagtacaactgggaagtaaagaacaggctgggccaggcgcggtggctcgtgactgtaatcccagcactttgggaggccgaggggggcaaatcacgaggtcacgagatcaagaccatcctggctaacatggtgaaaccccgtctctactaaaaatataaaaaattagccaggcgtggtggtgggcgcctatagtcccagctactcaggaggctgtggcaggagaatggcgtgaacccaggaggcagagcttgcagtgagccgagatcatgccactgcactccagcctgggctacagagcgagactccttctcaaaaacaaaacaaaacaaaaaaaaaaacaggctgtatgtggaaggctgtggctcattcatacacattatttggatagttccgtggctcctgcactggactggttccctcaggggaaaaattatccaaagatatatacaccgacagcacatctatctcatgtgtgtgtctttgtgtgcatagaaagaagtggagaggagagggagatatgaacacatccgttcctcaacctctcctttacgaaatgtgttcctaaaaatgagttgcaaattgaatgtttaaaatttggactatacagatccttgcgtgctataagggtagagcagaagagggtatacatgggaggacgacttctaaaaaccatgaaattttacctttggtatatatgtttcattttcttaccccctgagtgtcatgcaatgtactgatgattatttgggattatttaaaatattaagaaataaattaagttacaaatgataaacttaattttggaaagtcctaccttaaattccaattatctcagcttactgaaaatacaattcatgcaaaggagaaaacgagtttgctgttagggacaaggatgtgctggcacagatatagcagaggattcggcactggcttccactccttcatgcagtctttcaacatttgtagagcacccagtacatgccaggtgctttctaggtagcaagcaagagagaattgcttctttaagtgctttctccccattacattcaaatgggagaagcaaactaagtaaataaccaaataaataaatacttggagatagctgataccattaacctattaacacacccaagcttatgtggacagaaagtgaaggaaagatatttgagctgagttggaaagaaggcacgtcccaagtagagggaacaactagagccaaggtcttgagggagacagaggtgttgactatacgagaagagaaaaaaaggccaaggtaactaacacagtgcccacaaaccttttctgtagagggctaaatagtagagactttagcctttgcagggcatacggtttctgttgcaactaccaaactgcaccattgcatgaaagcaaccataaataatatggaaatgaatgggcagggctctgctccaatataacatttttatgaatgttgaaatttgaatttcatagaatctttgagtactacaaaataccctccttttgattcactatctaccatttaaagatgtaaaaacctttcttagttcacaggccatacaaaaacaggcagcaggccagatctggcccatgggacacagttttctggctcctaggctaaactcagtcaagtaagctgatatggtttggctgtgtccccacacaaatctcatcttgaattgtagctctcataatccccatgtgtcatgggagggacccagtgggaggtaactgagtcatgggggtgggtttttcccgtgctgttctcatgatagtgaataagtctcacaagatctgatggttttagagaggccagttcatctgcacatacttttttttttttttttttgagactgagttttgctcttgtcacccaggctggagtgcaatggcgcaatgtcggctcactgcaacctccacctcctgggttcaagtgattctcctgcctcagcctcccaagtagctgggattacaggcgcctgccacaatcatgtctggctaattttttgtatttctaatagagatggggtttcaccatgttggtcaggctggtcttgaactcctgacctcaggtgatccacccgactcggcctcccaaagtgctgggattacaggcgtgagccaccacacccacccctgctaaacacactctcttgcctactgccatgtaagatgtgcctttgatccctttcaccttctgccatgattgtgaggcctcccagccatgtgagtccattaaacctctttttctttacaaattacctagtctcaggtattgcttcacagcagtatgagaacagactaacacataagtgaatggcagaagaggggataaaagacagtatcaggagctagaagcaacagtttcggcttggggctttattctacgtgcaagtggagcaatttaaaatgggagagatatggtctgacttacgtttttaaaaaattactttggcagttgagtggcaattctgatgatgtcatcaacttccttgaaaaaaatgtgtcaacagggaatggaacactatcctcttgatcaagcagtctggagcaaaccatcttcccctcaaaagctctacggggcaaggcatggtggctcacacctgtaatcccagctctttgggaggccgaggcaggcagatcacctgaggtcgggagttgaagaccagcctggctaacatggagaaacgtcatctctactaaaaatacaaaaattagctgggcatggtggcacgcacctgtaatcccagcactttgggaggccaaggcaggcagatcacctgaggtcaggagttcgagaccatcgtggccaacatggagaaaccctatctctaataaaaatacaaaaattagctgggtatggggtggtgcacacctgtaatcccagctactcgggaggctgaggcaggagaatcacttgaacccaggaggcagaagttgcagtgagtcgagattgtgccactgcactccaaccccgggcgacagagcaagactctgtctaaaaaaaaaaaaaaaaccctctatggatctgtagatttctctctgtatttgaatcactgaaggctttatttttctttaatgctgattgtctgtccacaattttaaagatttcctcattttcttccatcactaaacatggccttggagacacgatgtcttaggttacattttcaggatttcatgtgtgttctttcattttattttcctttcacaagtgaagtcatctgaccagtaaccaattgaagttaaatagtcaatactgtctgtacatctgacagactctatccttgcctcaaatgtattaccatgagtaccggcattttcacatttccattttctactcatttttataatgtaagaaaaaactggagaaaaattcaatcacagctgtacagataaggggggtaagagagaaaaactggcctcatggctggcagacatcagagtacaatggcttcaaatggttttgtaaagtccaaattcaacaccggggttataaatgaataataataaagaaaagtgtggtttctcccttcccatcaattctgccctatatgagaggaaaggctgtcagggacttggtccttttaggcttccctgtgtttctctgactacccctcctgaatcccagtttccagtgtcctgtcaagagcctgacttgacctgtttattggttcatagactgtgcctggcatcttgacattcaacttagtctagcagcctagctccagctaaccatgccccagcagagagggagtgccgtcatgttagtcaagtcagaaaagcctttactcttgacaggtttggacctcttaaaaatccaaaggcattcaacccttgttagcctggacaagatacaactctggctccctcaactgtcataagaaatagataatgacaacttcttagacatacagcaacaaagaaaggaagtcatgcatttcaaactctcttcaagacacttaataaattaaccaaggtaaataagtaaccagatcaaatctatcagaatttttcatctcccaatttcagtctcttagttaaatttcaacccatcctatgtccatagaagtgaagccttctgtaacaaggctctgaataatgcaaaaaaaaagaggtggggtgggagttaagatgtgattctgtgacagctatagtctaaaatggccccaatgatcttcacctcccagtactcacatccttatataatcccttccccttgaatgtggctagactagtgactagcttctaagcaacagagcatggtaaaggtgacgggatatcatttatgtgattaggctacataagatgatgacttctgtcctgctacagaagtagcaagaatatagcagattgtctcccttgctcaggaaatggggcaagcccacatatgttagaaaggtccatgtggcaagaaactgagggtggcttctggccaacagccccctcaaggagctaaaatgcttagtccagcagcctgcaagaaactcaatgctgccaacaactatatgaggttggaaacagatccttccctatggagccttcatatgagatcacacccctggccaacaccttgactacagccttatgacagatgttaaaagcaaagaactcagttaagctgtgctcagagactactgacccacagaaactgtgagacaataaatgtgtgttaagtggctaactttgtggtaattggtcacgcagcaacagttaactagtacagggtccaacttgtcgtttcagtttgaattgctcaagtcatcctaatccaggagtcacatgttgtcaagtctctgcacacctctcgctgcattatcataagctttcatgaatttaaaagaacagattagaggttgatttcttctaaagaaccactacagtaaaccagtctcaatccctttcttccagcaaagggacatcatcaattgccacatcttcccctttgatgcaaatgacaaagaggaaaatcaaaccatgtcattgccatctctgagtccaggagaaagagataatgacagcacctggcctgtcttgcctcacatcaggaatgcagtgagatggttctgagccatggactttcccagaccatttgaatgagactgacatcatgaggaagggggtatcctctggttgggaatcctctagtggctgtatcattattttctattaaagcccctattgcataggaattttttcccatgctgatatgaatctctcatggaaaataaaagttatttttaactatgagcctcaggctataaattcattctccctaaagagttaggatcaagcaaaatcaaagaagttagaggaaggagagaagaacacatcctggagtgacttggccacacctgcaaaccatgtgccctgccccacaactgtcctctgaatgctcttctgggacctcttccctctcccttttacctgtgcccctttttatgtatttcctcctacatgctcatcccaccgtgccttcattcaacctgctcctaagaaaacttgactttaagacagtaagagctttccaactagctaaggttgattcttcaattcaatgtactactccaaatacttcaatccagagttcattaggttgaaggcatcatgctaacccccacagcagacatgtgaacagctgtgtctgcaaagcctttaaaaatgatccacaaacttccctgccttcttccattatagaatggggccagagtgcgcaccccaggttcaaaacctaaaaagcaggtttcaggccttgccccaaccctcagttcttgtgcagccttgggttggtcctctaaaccatctaagatccagcttcctatctgcaaaagcatcagaagacttgttgaaagcaaggattaaaatggaatggtatgcctgaaaatactctaaaaagagtcactgcgattagggcaaacaatttcaccttttcttataactcaaagttatccataaaataatcggttatcgtactgggagcccacatctattttttctcctcctgacattatcattgtcatgactgccactacatcttcagtaaagcaataaggtgggacctttggggtcttccaaggagaaaagcatgcttggccctcatacctagcagctgcaactactgagttgattgagctttcatcactgctttttacatttatacctcctaattcaacactgggggttataaatgtagcaacagttaactaacacagggtccaaactgtcatttcaattcgaatttctcaagtcatcctaatccaagagtcacatgctgtcaactctctgcacaattctcactgtattatcataagctttcataaatttaaaaggataggttacaggttgatttcttctaaagaaccactaccgtaaaccaatatccctcctcttctctagtaatgaggtcatcaccatctttatttatcagcactgcaagcatgcctccctgaagcagccttctccctccttctaaaccttctgagcttagaaatcaaataaaaacttgctagaattgtaggtaaagtaagagctgctggccactgaaggagagactaagggctctcctctggaggaaaaaacaagagctttgtgtgtttaatatctctttggtggctcagaggctctttagcttctttctaggttccacgcagtgcattagaaggcaagtcttctatttacacaatgtctggtatatagttaccatttcctatttctatctaggatctcacctggtgcccacccaccggtgttgatgtgtatctgcatgtctaatacacaacagcaatgagaccatgggcattccactcttaaattaggaatttcccccgtatatatactcgatatatatacgggggaaattccttatttgatatacagaggaaattcctatttaagcatgatcatcatttccacactatttattcaccattttatatatgttacttcatgttatgctcacaaccatctaatgagataggcactattattcccatttgctaggcactattaatttccataaagaaatttaaagctcagagaggttaactgattttcccaaggatatagagagagtaagcatgatgattaagaatcccaacaagtctggcttcagagcccatccagatggcgatgaaaagatctccaacaatggctataagttcaagtcacattacaaatttttcctaatgaacagaagtgaactctaaaatccacccatcaaattgaaatttatcacgacacatgcgtgagttaacaattctccaaaaggtaataatattataaccaccactgctactatccctcaccaggtatttgacatgcatcctctgaaatcttcataaccccctgccagactggtagaattattcccattgacagcggggaatctgggctcaaaacatcacagtaatttgcccaaggatgcagactcagtaagtggcaagagctgggattttaattcagctctctctgactccaatgcctcttctctttccaacatgttgagtgacccaagatgagatatatttaagggcaaactagtcttcaacaatatagtcaatcttcacaattcagaagattcttgtgaatctttcgcagcttcgaaactgagacaatgctggtctggaaatgaacatagctgggtggaaaccaggtttgtccagttaacagctgcgtgactgagtatgtgcataacctcactaagactgcatttctttatagtaatgcaatttcacagggtcttgacgtggattaaatgggataatgtgtgacatatgtgcaggtatcaaggtctgtggcacacagagggtactttaagtattctttctttaattattatctttctttagaaaatataaatatgaattgagatttctgaatgacagatttaagataaaacagctactattatacaagacagaacacagaatcttcgattcaagattaaaattgctgaaagtatcctagaaatcactgaatattcatttattcaccaacattaagtgagccccgactatgtgtaggaattgcgctaggcatgggggatcagcagggaaaagaacaaaatacggatgattatggagcacaaattccagtagaaaaaagtcagaataaaatagaaaagagtctaaaataaaacacaaagataaacaagaagaccatttcagagagttaagtgttatggttggagacagcaaagctccctcttatttggctgagaggaaaactgatctccaaaccagagaagggatttgattggccaaagaccccacccaggattaatggtgtgtctttgttctctagaccagcgattctcaaattttcacatctatcagaatcacctgaaagggtttaaaaacacaaatttctgggtcccacgccagagttttttattcagtggatctgctatggagcccaaaactttgcatttctgaaaagttcccaggtgatgctgacactgctggtccaggggccacactttgaaaaccactgccattgaggaacacaaccataccagaaagtagtgaggcagaaagagcagaggacaagtaccctaacccctctcctcctgccataccatctcctaccagtgccaaactccatcactaaactcagtcaggaatcagaatgcaaaagagtcgaggtcatgtagcctcctggaacccagcgcagtacagagaagggctccattaacacaattccctccccttgccccttttcacattaaagggttcaaaacctcactgaggcttcccactagtcctagtctccaagtgcctcggcatcccttgtgagttctcttaacctcaaccccgccacatgaatagtccctttgttaaagcctcttgacacacaggagttgaattctgttttctgttaagatccggagagatacaccaccagatcccagacagttccactagtgggataatttccaaaactgacaaacagctcttctatttcttcctaaagtaacagctataaaatgcaggtcaaatatcagataatcttttttgctacacaaatacaaatcgtatatgcaattcgcaagcccttgcacaggctgtgcagcaagatcactctaaatacagcttgtgggcctgggatgagcattagagtgaccgactcatcctgatttgtctcaaacattcctgcgttttcaatgagcactgaaggtcctatgtcctaggaaccatctccatcctgggcaaacgaggacaattggtcaccccagccacgcactcttatgttttcttgcatttatgatgcctccactgaactcccagcaatagcactataaccaaggatggctagtatttatggagcactttccatgagcctggctccttgctaagcatttgacatacctcacctcattaatttctcacaaccatcctacaagcaagttactacaatttgcctcatttcacagatgataaaatcgaggctcaaagggtttaagtagcttgttcaggtcacacatacagcttataaattagcacaggcttaacttgagcccacagtctgagatcagagtctgcagtcttttttttttttttttttttgagatggagtttcactcttgttgcccaggctggagtgcaatggcacaatctctgctcaccacaacctccacctcccgggttcaagggattctcctgcctcaacctcctgagtagctgggattacaggcatgcgccaccagacacggctaattttgtatttttagtagagacgggggtttctccatgttggtcacggctggtctcgaactcccgacctcaggtgatccgccggagagcctgcactcttcaccaccacatggttcatgacagagcagatggactcacctgccccagatctgattccataaggaaggaagattcagccaagaactaccaaaagggcatgttagaaaccaagcattaacactgcagtcacagagcggaaacttagaggggatctacatgttcttcattttaaggcacacaatgaaaaagtcaaccgcaaggtgtttggtgcctttggaaaatcagagataaaattatgcaggcccttatatctcagaatcagagattcttgcagcaaaatctgtggcattcaacacctgatgcatcctacaaatgcaaaagcagtcccatctgatgccttggcttcgaactcttatttgtaaaactggaataatgatcacctgtcttaaatccacaaggtggttgtcctgtggagaaagtaaactcaactaactctgtccagccagaagtgttttcctaaactgctgtgcttgcgggagccccagaggtccaaagtccacagtgtggggtgatccctggggtttggtatacggcaccttcaggtgctgggtccccagtgtgaaatcaggggcagctatatctaggggctcaacctctgttccaggacaggtgagggtccttccctcagaattacctgcttgtatgactgggatagttgagactcacttgttggggagatggagcttccttctgggaaagacagtctctctctcctgtacttcttattcccataaaaatcttctaacattcgacatcacatggtgattaagaacctggactctgaatgagacgaccacagtgtgattgtgaccaagcccttgaacctccataaaaccaattatcttatctgatacatgggattgctgtgtctgcctcatgggatcattatgagaattaaatgcagtcttagaatttccccaaagacatgctcattgaaaattctgaacaaaggctttccacccagtaatttcaaacaggacctaattttctccataagtatgaattttgcacagcacatggcacaaagtaagccagacagagagaacataaagtaatgcccaagaacacagaatctagccttgaattcctctggctcaagtcaagttcccacactgactagctgtgtgacctagggcttgctacttaaccactctgttcctcagttttgatgatcattatacctacatcataacagtgttatgaaaactcaaggagtgataattagtaaaacccttgaaaagtatctggcccattacaagtatttaaagcatgtaataatgttagtgcttcctatttggtagtcatttcatctcctgcatttattcctccgattttcagtttagatccttcatattcagcagaccctgctgcacctgtgattttcataactcttgaatctagtccctgttattatcgcccatcatccatcatttcaccatatgatttttccccttcttgcattttctgcttttcattccaacttgagccaaatgctcttctcctctgtatactcttttgggtttagaaaccttcctcccaggaaagtgaaaatccctgctgtcatattcgaatgtggacagttctaatggagtcactgtttgaaatgaacaatcctggaaacaggttgctttatctcctggacctggggatttcaaaacttattccttttgaacaaccaaaccatgagtagtgtcaaataacaaaactgatccattgggaaaatatattttaatatatttaatctttatcaaagatatccaatgatttggttttcagaacataaaataaaaatcctaaagtcagaggcctagaagtttagtctttaagaaacatagaaatcatctggacatttcacagatgggaaagtgatgcccaagttcacagcatctctaaacattgaaaagactgcgcaacattattctttgagtcaaatgtgcctttctgacgcctcaggcaaacctaaggccaaaggctgtcctatgaaagaatctctgctatttctctgggatgcgaggaagtctcctccatggagatgccaggaaagagaaagagacggaggtgtgacaagggaatagaactgatggctaagaaggtcccctccacgggccccatgcactcctgttcaaatgtctccctgtgtctgtgataaagttctctatttcccttcttctgcatgatgcaggggtgttaggattcccaagagaaatcctttacaaactcggaaataaggccttccatatagaaaataaaacctaaatttgtcttgaaaagatgacagaagcaaactgtacatatatttaaaattcctattatctgtaccttattaataaatcttaaatttcaagaacatctcttggagctgtgactgtgccactgcactccagccgggcaacagaacaagactccgggctctgactgtgccactgcactccagcctggcaacagagcgagaccccgggctctgactgtgccactgcactccaacctggcaacagagcgagactccgggctctgactgtgccactgcactccaacctggcaacagagcgagaccccgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagcgagaccctgggctctgactgtgccactgcactccagcctggcaacagagcgagaccctgggctctgactgtgccactgcactccagcctggcaacagagagagaccctgggctctgactgtgccactgcactccagcctggcaacagagtgagaccctgggctctgactgtgccactgcactctagcctggcaacagagcgagaccctgggctctgactgtgccactgcactccagcctggcaacagagcgagaccctgggctctgactgtgccactgtactctagcctggcaacagatcaagaccctgagatatgattgcacagcagcacaatcatagctcactgcagccgcaaacagacatcactttttaaaggaataactgaaatgcagaaatattacaaagagaagtgcaattaacacctaggttcttctccaccaagaattatcaaccaattttaacaaattttcttaaagtatgttctccttttcaaaagcaacagaatatcacggacaaaggcaaaatgccctttatccaccatcctagttccatttttcccatacctcttctaaagagtgtagccttccattctgctttcaatgctgacataaacttacatagtttgattattaatacatatttgattgatgtatccattaaattacccctgttttctttccacagaagaacatgtggatttgcagatgctgactttggttcatgtaccagaaaatcctgatatttgtaaatagtccttaaatagatgcccagattattagtatgaggtcatccaacatgctgatatagaagggaagctgcatagcaaaaattgggatgcttctatgtacaagcaggattctgctagtttgaagaggtcactagacctcattagtaaaccatgaggccagaaaaagccagcccaagatatactacatctgcttcagctctgtgtagtcaccgcactcccataatatcctgtatttttggctaaataaataaaaaatgtataagtttgggagcacatacaaggtccttgccagataatctgtaacccatctgcaatgacgccattggtgtcagaagtgggacagacatgaagagcccaccacaatggccacattttggatagggatcagaatatcaaagtaggacacaatgagtaaaacatgcctaaaacatgagaatttgcggggagctgagtctagtggaatttatccatggttcttctcccttcatccatttggacctgacatatagtgaaagatggctgggacaaaggtagttagcacaaggcaaaattcctggaaccttttgtgtgagccaaagcagtggttagaactaaggatctccagaaaagatgaaaccccagaaggaggaaatatctgaagtttgagccaaaaatctatggatcacaaaaggatgctctcaaattagacatctgaaaaggaaacctggaatgggaaagataccaaagacccctagaatcccaggtggaacaggtggtcagcagctttccagggacaaatgataactgctgaggctttggaagtatgaggaaatgggaatggaataaagaaatgcttcaatgctcatcaagccaactctcaggcagaacaattgcaatacagagagatttacacaaagacatttaaatatatgttaaatatttcgtatgtgggaagaggaaaagataataaggataagaagtctgacttcatcaagtcaaccttcaataaaaaagtgacccatcaggaacctggccccgttacagttttaaactaaaaaattctgttttaaaatatgtgtatactttctaaaggcagcagtaactttgaaatttgttcaaattaattgcacttttccaacaaaaatggtgttcagagcatcaagtcccagaaatattttcctacttggaacagggatcttccaagaggaaaacttaaagaacttcattgagatggaaaattcaccttgggaagtatacccagaaaaagtttataaaacttctgctgaagcaagggtgttgtagtatctggatttggttgggtgtttgcgtgattaagctgggcatctcacaagttgaaaaccatacatttcctcttttccagtaggttccactgctccttagtaaacctaataaaaatgatctcaaaactgcaactgaagtgttagacagctggcctctacttcatcccagacaattttgtttaggggaagataaacaccctgaactggagccagctgagacacagggaggaagctggctttgtgcctggcttctttaaggctagaagctctgggaaaataactaatcattcctgacacccaccccgcaaccctgatttgagactgtttagaatcttggctcaaagttgtgatttctgagctgaaagccactcccccattccaatacacacactttctatttaaaaaggtgaaaaaataatgcaaaggttaagagatggtaaatggacaatcttaggcagaggaaagattcactgacaaagaaaaatgtaacagtcaaaacatccaaagctctggatctgaaaagagaagaaagactggacactgaaatggctttgagctcaaagctgcaacagcagagcagaacaagttccttgacccaggcctgttaagtgcatttgtgcaggttccacacaacaacaggcagcagccctgacctagacacctagaacatggtacccccacctccctcacacccaaccttgcactgccagatgtagcaagactgaaggggacaggtaataaatgagaaactgctcaaaaacccaagcccctgaaagtggaggccaaacacttccccaaggcagatgaagggtgaactcaaggtgtcttagagcactcgttcccagggtcaccttgtagaaatgactcaaaaggacttagggttggaaccatcatacattggtgcctcttctaccaaaatacagatactgcctagacaagaacaatggggatctttggaatcaccaccacccccgaatgaaacaattaaactgtaaaaaccagtaaattcttgaagcacatctccaccagaagtccaatgtctggtcagcccatttagattctgacaaaacatccttccttcactgcaggatctcctggggccctaaacacagttaccttgaaaagaatattgtgacagtttcttctgtgatgactgtactactgccacaacaaccaaaaccaagagttcaggcatgacgtgtttcaatccatataataacttacgtgtttacatcagactttttaattgctataacttatcatattctctatgttagttttatggagcccatttttaaacctctggaaatgggttagaaaggtctaaaataagcgccaattttaaaaactgggatatgtacatgtaataaaaatattaagtttcagctaaattatatcatagccctaatctattggtgttttttataaattggtttttgtggaacttagataccagtgtaaaaattgtagtcttacaaaaacacagtcgtacttcaattttgggggtaaaggttgaaaagttttctgatggatcttcatattaattcacttctactttctgacatgcctaattaacttctacaaaacttaaactaaatcccttctgagacactaaatctctctattctaaggcctttaaagagtgaaagcctgacactgaactggcattagtgcccccaaaataaaaagaattaaaagatctgaacacacttcaaaggttatatttgtatttttctccaagaaacaaggtttcccacacttgtgtgtgacttcaggttcctgtggtgggcagctcctgaaatggttcccaatgacccccacttcctggcattcatgcctgtgatggttaatcctatgtgtcaactcggctgggctaacagatgcccagctagctggtaagatgttatttctgggtgtgtgtgtgagggtgtttctggaagagatcagcatttgcactggtcaactgagtaaagcagatggccctccccaatgtgggtgggcatcctccaatccactgggggcccgaacagaacaaaaaggtagagaagggcgattctgctctcttggcttgagctgggacatccatcctctccttcccttgggcatcagtgctcctggttcttgggtgttcagactcaagtcagagcctacaccatcaacccccaaattctcaggccttcggacttacatcatcaactttcctgggactccagcttgcagactgtgggacttctcggcctctaaacctgcatgagccaattcctataagaaatgaatcaatctctctctctctctctctctctctctctctgcccccacctccctcccttcctctctctccctgtcatatatatatagaaagagagggagagagagggagagagggatatatatatatatacacccacattttttttttcaaacagagtttcactcttgtctcccgggcaggagtgcaatggcatagcctcagctcactgcaacctccacctcccaggttcaaacgattctcctgcctcagtctcccaagtagctgggactacaggcacacaccatcatgcccagctaattctgcatttttagtaaagacaaggtttcaccatgttggccaggttggtctcgaactactaacctcaggtgatccgcccacctcggcttcccaaagtgttggaattacaagcgtgagccaccacccccagccaatatataatatacatttaaaatgtgatatataatatatatgccctattatatattctaatatatatagcctattggttctgtttctctgcagaactctaagacaacttccttgtgcaattccttccccttgagtgtgagctgaacctagtgacttgcttctgacagaatatgacaaagtgatgtgatgtcccttcccaaattaggttacaaaggactgtgacttccatcttgctcacactctctccggctctctcacttgctcactctgacaaagccagctgccacactgtgagctgtctgatgaagtggcctgtgtggcaaggaactgagcgtggcctctagcaaacagctcatgagagacggaggtcctcaagccaagagcccgtgagtaagtgaatcccgccaacagccacggaagtgaacctggaagcagacccttccccattcaagctgaactgactgcagcctgtgaggggccctgagccacacgacccagctatgccacacagattcctgagccaaagaaatagtgagacgataaagccactgcattgggggagtgacttgttattaacagacaattaatatagctcctttagaacaggagttgggcctacttttccttttcagaaagttggtgcccaagaaagaaacatggacagccgggacctgactctggacctgacactgggcccaggcacttggaggccaattccaagatgctaaagaaaaaaagacacggtgacctcagcttctcagtaatactcactgaaacacataatatggcaatgtggcaaaattctttttaattagattaatgagttatcctattcaaactaactttacaaaatcaaagagataaacaatcataaatgcatgctgtttaaaacctctttcttttctatccctaatgccaccagctgttcccattttaccctgctgtatgccagtgttcaaacaaaacaccaaaaatatgcacccagattccgatgttcccacaacaaagggactagggctctttaaataataactactattataataatataataaataataacaaaccaagacgtgggcctgaaaatccttgttgtcactggaaaataaggactctctcaaggaggtctggaggtggtaaataagaacctggtttgaaggagcttccaatagccaaactgatcacttaagggggacacgcacaaaagcataattacagtcaatcagaggaagtcaagatcacccaaggccactagtacctgtgatgatccaacatgaagcactgttttttaaaagtcctgcttgctgatgtgaacccattcattcatgctcagttacaaagagacaaatgcgtgatccctaagggatgactacataaccacccaccaggaggtcagggaggaccaagagaaatgggtttgtggtcttgtgtctgctcctagaaccaacaggataaaagggggagtaaagcaaaatgaggggtggtctgagaagaaacaggtttccaaggtcctgggaagcaggagctggaacataactgtggaacatgtagtcggcagcactgcattcttccacagaaaaggataagctccacgacgctaagaaagttagaagtttgcaaacatcttccttcttttttttttttccgagacacagtcttgttctttcacccaggcagaagtacagtggcatgatctcagttccctgcaacctccaccacctgggttcaagcgattctcatccctcagccacccaagtagctgggattacaggcacatgctaccacacccggctaatttttgtatttatagtagagctggcatttcgtcatgttgaccaggctggtcttgaactcctggcctcaagtgatccatccacctcggcctcccaaagtgctaggattacaggcgtgagccaccactcgcccggccgtggtttgcaaacatcttttaagagcagcgcttgaactattagcgtgaagttcctcctgggtgttgatggaagccccctacaaaggcagagacaaagctggtgctgagctgttttctcctctgttcatcaaaccaaaggcgcaaaaaaaacaaaacaaaacaaaacaaaaaacgttgcatctgctcctgatccaaggcacttctactcttctgttaaatctctacatccttagcttaatgagaaaagaaatgaatgaatgatctattctctcccccacaaatccataccctaccaaaatattcagggtaaaagttattcgtgtctttaattttaatagacattgccaaattagcactcagaaaggctgtttcaattttcactactcaaaaatgaacaaagctacctaattgctcagatccttgtcaagacttgatagtcttaaacttttgcatttttgccaaattgatgaggggaaaaaatgctacttcatagatttaattcacagtctaaagagcctttcaaagagcgagagataatgctttgcaaattgctaatacaacaaactattttggaaactagcaagagataagtcatagtaacgccatttccttggtgcctgttttctgccggggaccaggcttgacaatttacaggtattatctccagctcttgcagcaatgaggcatcagtagccccattttacagatgcagaaaaaaagatgcagagcactgaagtaacttatcaaggccacatcacaagtgcattagggagctgagatttacacataagtctaacttcacaaaggcccgtggtcaaataaaagttttaacagctttagtccataaaatttcatccatcatcagggtactattctataccttttaggaaatgcagagttacacgaccatcaccaccttccagtttccaagtcaagaaagttagaggtttgcaaacatctcttgagagcagcatataaactgttctctcaggctcgcttcctataaacccctgctccatgcccaaccctaggcaacaactggtctgctgtctgtctccatagatctgccttatctgtgcatctcataaaatatacagtctcttacatccagcttcttttgtttagcataatgttctcgaggcccatccatggcgtagcctgtatcagcagttcattcctttttattcctagtcatattcccttggagggatgatggacatctggattgttttcaggttttggcttctgtgaataatgctgctacaaacattcatgctcgtgtctttctgtggacatatgttttcatttctgttgggtagattcctagaagtggaattgctggattttatggggagtgtctgtttaactttttaaagaaactgccaaactgtttaccaaagtgactccaccattttttattccctccagcatcaaacaaaaattgtcaactgaatattcaagaaatgtgagactttgcatctcttccacttatgctccaggggacgtgtttgtgtgtcacacgcactttagcagcctggcttcagtgtgagaaaaaattaagtctgccacactgggggactgcttcaatttccaggtgacttaccagtctgaaggtgcatctgatggggtttctgcacagcccttccgtgtggatatacctaggaaggactaactgaaataatgctcacatttgaagataaaataggccctaatgggccgggtgcggtggctcacacctggaatcccagcactttgggaggtcgaggcgggaggatcacaagatcgagggattgagaccatcctggctaacacggtgaaactctgtctctactaaaaatacaaaaattacctgggcatggtggcgtgcacctatggtcccagctattcgggaggctgagggaggagaattgcttgaacccaagaaatggaggttgcagtgagctgagatcacgccaccgtgctccagcccggcgacagagcagtgagactctgtctaaaaaaaaaaacaggccctaatgatcaccatgcctcactgacacctctttccctgtcccgctgtattgacacatcgattcccatttttcatggttgacttctgttacgtccctttggaatgtatatctagaatcctcactgggtccctctgtatcctctttagcacctgcaactcttaccaatagataataaataaatgccattatcctgctcatttctgcctctactggcaaataaaagtgtccagcaggaccatatgaaatgctgaaacccatgatcctaaccggtcaccctaacccacctggacacacacactattgatgaacccctgtccctgtggctgtatctgatttttgttaacccattgaaaatatgtggctttcttcctctccatactaatctgaatccattctgtaagatttcatgagacacgctaactgctttctaatatctatgtggtattgcctcctggacccaattctgtaaggtgtttgcaaatgctattatacttgtccgacatggtttgttctcaataatctcagagctttttaatttatttattggaatgccatggcccttgtttgttttcttattctttgcttgtttatcaagtgcacaaagtatctttttcccccacagccccagagtgctgtgcagttgatctccaggttagggaagagcagaggacagagccgaaaagcaaggaaggctgcacacgggagagtgtaggaagggaaacagaatgcatccaaatgttgtgtcctgacgcaatatgtagccatttgtggtttatcaacacttctaagtcagagagtaaaatatgcctaaaagtcaacattccctatttaaacccttgaatggccagatttactagtgtcatctgttggcaaatttcattggcaatctctttgtaaaagcagttgcagggaatcaagcccctgaaaagaggaaaaggaggaaaactgggtgggcatggtggctcacacctgcaatcccagcactttgggaggccgaggtaggcacatcacctgaggtcaggagttcaagaccagctggccaacatggtgaaaccccgtctctataaaaatacaaaaattagtcaggtatggtggcacacactcataatcccagctacttgggaggcggaggcaggagaattgcttgaacccaggaggcagaggttgcggtgagccaagactgcaccactgcactccagcctgggcaacagagtaagactgatctcaaaaaaaaaaaaggaaactaaaaatcatcaccaaacccagccatctcatggccagttcactatttagcataagactgatgccccacccgccttggcctgtgcacatacacctgtgctgaggtcagtaacagacaaggctcctcttgggacaaagtgcctattatgtaccaggcactcttccattcactctgcatattgcatcttatttggttaccacaaagtccagcgagacagctataattatcctcactttacaaatgagaagctggggagctgagaaggtaaatgacttgcccaagccggcataggtagaaagaagcagaggcgggatttaaactgaggacttcagatgccaaagctcatactcttttctccaaaccaggctgcctcctgagttaaattcccctgcgcccaccctcgcccccccattatagctgccgtgagactctaccatctcttcaccatcatcagtaaatatttatcaaggaccaccgcctacacagcattgctcttgtttccacagcaacacactgtcacggagtcaggggagtatcctgtgcttgaaagagtgatgctgtcatgtcctctgatcgtggctgtgaaaggtgacagctatacgactacatggaataccatctcagctggcagcctgacaccttcaagagctgtgctgagtacaagcaagaagaaattaagttgagtagaaagagagtcggttgtaacccaagaatatggtctgcttttactatgtgtttgcgattgttgctggaacagaatttaagccacgtttgcacattaattgttcttttattaggaaacaaatcaagcaatccatgacagaaagtaaaattcgactgtactgctaacagttccccagaggtatccaacggtgattattgagttaaatgactacattgctaacaattgcaattgcaagtcagtcccctataagatacatttttgctctcaatatgtggattctgaaacccactagtaaatgaattcattatccccttattcatttaactgtctctctcttcccccatcccaaatcatgttttgccacattgttaagaggctgtttctaaaggttttttgtttgtttgatttttactatcattccttccaaaaaccgtcgtggctcaagaaatatgtcttagagtaaggaaaaaggaaattgccttttgatgacaagcttccgccccgacttttggacactgagaccaacatgttacagcaaaacatattagcccaactatgttatggatgtaaccttataaattgaaattgctttcaagattgggaattttcagatcaaaagaacatggaaaacacactacttagttttaaaatgtatttgtccaaacttgccaaaagttttaaataaaatactttaaaggaaatcaagttattgtcatatttatactagatttgaaatactaacaatttctgaatttaggaataaaataagataagtccatttttaagtcaacatttacagtattcttgttttgacaaatacagatgttcatgaggaaccctggggaaaaaaaatctaatttagatggtctagttgccgttaaactggaaaggagaggacagatatatacagaaaatccccatttctacaaatgtgtgaggcttagaatgcaccagttctccaatacaagctaatcccattcgtttaaggagcccctggcacaaaggcacccacttgctaaatatatgctatatcgcaggtttgcagaaaccaccctgcccaggtagacccaaaagaaccacagatttcttcccaaaccatattccaggatttcttttctttctcctgcattctaaagagcaaacaaagaaaaggtgctcgctcctcacacttctctaaatgttttaacaaaaggctgctgaataaacacattactcatttaaaaattgaaaagaagttctattcctgatatgaaagcaaccagatttgcattttaatagttgtgggcgagcgccacctggcgggagcatccggaacgggcggcgttcagcactggacagcttcccgagccggtacgggttttaccgcttgctacccaagaacgattcgagacccgtgatggaatatttttgatcctgtttctgccgcgggaacgtgagtggtattaatgtgtggttggccggtcatgccttagaggatataaaatctgagtcacgaatcatgcctggatccccaggactgccccgggcatcctccctagtacccctccctcccctagcacacctaacacaccccccaaaatgaggaaaacaagaattgtgcaccatctttagaatggtgctgtagctgtccctcttctctcacttgctaatccaacctttcagcttcacacacctcaaaaggagtgtcttcgtcacccaacttcccagccagggaaacaggctgtcccttcacagaagtcgcctattccgcttccattttagtaccaagcaaggaaggctctaaagcatttccaacggaatgtccttccagcggcccttaacctcagacgcagcttgtgcaaagacgctgtacctccccacaggttcgttcttttgctctttctttcttcctttccttctttcggtgaaataataaatgggcacagctgttgcttagcgatccgaaaccagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccgggcgtcggtgccgctcctcgtctcgccgccccaaacactcaagtggcagattccgacaagtgggaggcagcaagtggaaatattcgcaacaaccgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctccggggccgaccagctcgggccgctggcacagtcacgcgcgtccacacatcacccccgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccacaatcgtcgtccccctcaattagccgcccaccccaccttcttcttcacccacatctctctcttgtccccaccaccacgcggaagggggcgcagaaggggcatgaggcatccccccaccccctacaatttttccctggcagccttccctttccttttctagggagacagaaccttgtagctttttcccttttcttctcggtcttaacaaagacctggttggggctgaaagcctaaaaccatagatcagggttggagctgtccctggcagcccacggcccacagcctggctctctgctgtcctgggaggcagctggtacctgagtcttggctgggggtctgagatgtaaaagccaggggcagggatacccagaaatgcttaagggattcacactttgtgaacactttgctacctggccaaagccctccttcttctgtgtcagcacagccccccacccccatccttgttggggtaccagggactggactggggagactgtaagtgaattgtgaaaatcaagcatggcagggtttccaaaagtggggagccccaggctctggacccaagttggcatggcagagaacacagggcgtcactctgtcagtccccagttcccagtccccactaggtaaagtggcccagttccctggcatggaagcccaatttacaatcccaggcaaattcttccacccctctccggaccccgactcccaccaccaccaccatgaccgtgaccactttcaaaagctgacgtgcttggactagcctgttggaccagccagtgcctcccacacttgcctggtcaaagaactaccaggaagatttctccaagtcctgcttcccagacccctgctggggagagtggaatttggcaggcctgtcgggggtggcctgggagttgaaccttttacaagctgctttggagattaataattctaccaatatttatggtgcatttaattgtgtgccttactctgtgctgttctctggggataccacaatgctatagcccttagggacaattggaatggaaagatcccttctgctcagagctgagcttccagctgtttgctccatcactcactcattctaaccctgccttgggcagatgagcagttaggaagtgtgcgaggagaggcctgacccaagaccaccacaagcgaccccagtcatggcagatcccaggggatgacccgggtggggagatttctaagccactaaagagcttggtgtcacacttgtaacttgttgccactttcttgggctcctgccaattcatcccctctctcaagctttctggaaaactataaaatagcagttctcacagcatcctcagagcaacgccctttggcacccccctgcactcctgctttagggatgtgatatcactgcagacaaatcccccaggtctgaatggggttcatgtggccccgaggggaaaaaaaaaattcagtagtcactgagctggtggagtgggacctgatcctgcaccaggacttacctgcccaggtgcaccgtggtcatgaaccgtgaccctctgtgctttctaaacctccctctactccgagaaactgccccctctccttcagtagcacgtgctgccacctgctgcccggccaggctctggcacccacagcactgccacgcttttgcaccggccagtccctctgcctggaagccctgcactgtatcatctccctgggaaactcacactagcccttagggcttccctttggaactttggccagcgggcccttcctgctcaaggcatgttccccagcgcaggtcactgtggtggtgctttttacattgtggaaatgttgtctcctcttcatgtgttctacaagacttgagttgccaaagggaacctggacacttaccacagggctgctaggagatgggggtgtgggggtggagagagagggctggcacagggctgaagatgccttacacaaagcttccagctagctggcttctcaggggagggaactaatggaaagttacagcatcatctcccaccctcctgcacagggagccctctttcccctctgaccccatcagcccagggagctgggacatgaccaagatttgcttggctaggggctgggcccagcattgcatcagtgctgaaggaaggaggcagggtgagctttgtaagagatggcattctgccctacaaactcttttagttatgctcagacagcaggcctcttatctttggactgtgtccttaaccccatgaaacctttggcgagacctctccgtgtgtcagtttccatatctgcccagtggcttccctttcagttgtgtcagggaccaagacaggagtgtccagacatttcagctacagatctctctgtcgagcagttttaggggaaacctgaaacttggggcatcctttcaacaagtgtgctggccttttgatgtgtgtcagggatcttagggctgtgggtttgcagcctaaacaacagacatggtaactgccatcatgtagcttacaatctggtggaggagactggacaaagagaaaggggtaacaaccccagagctggtccccatctccccagccctgcctcgcccccagcggtcagccctccagtggggagcagagcaccagggggaagacatctgctggggccacgtgccttactaattagatttccaaaccatgtatctagtagagtgtattctatgtttaaagtatcaaataaagtccagtgaggaaagtctagtgatgtagctattgtttgatccccatcttacacatgaggacactgaagctcaagaagggcaaagactctccatgtaggaagggcgggaaggttcacttcctgtgttgggggtggctgctccattggagcctgtcttcttgctgtggcacagatagccactagtcatttaaagttcaaatttagcatttcagtgcttggccacaccgcatttcaagtactcagtagccacaggtggccagtggctgctgtatcagacagtgcagatacagaacatttccaacatcatggagaattctattagtgctgctctaaaacagaggtcaccaaacctctaccacatctggcccactgcctgtttttataaataaagttttattgtgccacatccatgcttattcatttacatactgcctatgtctgctttttgcagaaagttctactggacagcactgctctagagcagaggttagcaaactccacccatgggccaaatctggaccactgcctatttttataaagttttatcgaaacacaaacccctgtattcatttacatattgcctacggccgctctctgaaatatagcagcagaggtgagtgattgtgacaaagatagtctggcccacaaagcttaaaatatttactgtcttgcccttcatagaaagtttgccaaccctttctttagaggaagtcttacagcacaatttgacaattattgatctaaaactcattctcaaagtgtggtttctgaaccaatagcatcagcctcacctgggaacgtgttagaaatacaagttcttgggtcccaccccaggcctgctgaatcagaaacgctggaggtggggcctgggctctcatttcaccagccttccaggtgattctcatgcatgttcaagttggaaaccactgttccaaaacacagagcaaatgccaacaagtgactggtacggtgagggtgcgaatgggctcctgtgggtaacagaagagtttggaaagatgccaagagagtgatagcccatctgctgcctggtccctcagcagcaaaacctttgacagccgttccacggaggctgtgccaaccaggggaggaccctgtaccagcccccggcgccatgctcaggccccactgccatcggccccgccctcccacggagttgtcagcacatttggagctgcctccacacataaattcatggaccagctgtctcttttaatctggttgcaagatgaaaccattaatagatgtcagacacattggcaatgatctcttcattaataatttcctcctttctgaggaaaaagatattagtaacaagccaccatcaataattcaaaaatacaagttaacctttctattagcagagtgactgtgcacacaccgcagatgctttcagagccagtagttctggtttgagtaatgttttgatggcaggaatattaacatgcattaatgctgtctgtcaagatgtgcaaatataaataacccaaatgcaacttagaaatcttaagtattttcaggtttaacctcatgatccaaccattttttctgtttaaaaaaaagcatgtagtatccaataatatcactccgttcaaaatcaggactttgtaacggaatccatttccagtttgaggtccttgtggttagaaagatttccctaaagctttaccgatactgccgattgatagtttctccctccaaagttggatctgcctcctggggaagtaacagccgggatgcccttccaggtgaccttcgtttggagattgggtgtgctccaggtaagcatactcaatttcttaaaacccttcccattcctcttctgatagattttcaggcccacggcacctggttcctcttctcagccatgctccattttgataacatccctcttctggggaggccttgcacctgcctgcattctccacacctccatttaccacccaagtgaccacacactcatcactttccctctccaaatgtgtttccccatctgtgaaattgggtgattattcccacctcgctgagctgagtgagaattaagtgagttaatggatgtgaacacgcctagtacagggctggcccactccgtagcccatttcccttcctttcttcccacttccaagtcttaaattcaccagatcaccccagccttgactctagaccaactgtcatagacacctggacagcaacatggcacggaaggccagctgcttcttccctgggccaaaataccaacacgtggtccagattgttgccaagtagacctcaatgtctgaggtgtcctggatttaatgccagcactgcatctcacccgagtggcatctgccaaacagctgtttctggtaatttttttaaaaagctaagtgatgggtggcaagtacccatcacaggtgttttcacttctgactgacacctggcctcattgctgggcagtggggatgttaagataaagtgatcccatctgcaaggaggccacagtccgcccacactgagaggtcacccaagcacactggggacagggtggtgttagtgtcaggggttgaataatggatgtcaaacatgattgagatatggccccaggctttacttcttgcttccagcaaagtggtttctctgatgaagcaagcaaaaagccaccattcgtgtaacagcttggtgccctggaattgagcacatgccttttcagagcactgaggtccccgcaagaccttcagccctggccaggtgcggtggctcatgcctgtaatcccagcactttaggaggccgaggtgggtggatcacctgaggtcaggagatctagaccatcctggccaacatggtgaaaccccgtctctactaaaaatccaaaaattagctgggtgtggtgacgcatgcctgtaatcccagctactcaggaggctgaggcaagagaattgcttgaaccagggagtcggaggttgcagtgagccgagatcgcaccactgcactccagcctggtggcagagcaagactccatctcaaaaaaaaataaaataaaaagggcttcggcccttctcctggtccctgactcccaactcagattccagaatgtttgtgaacctgttgcttctccccacctccccgcagcaaccttagctctgacttagcttcttactgcctgaagtcttgtccctcccaacccctccccacacacagcagccagagtggttgttgaagaagacagtcactccacaacctgttgctcaccagcttaaaacccttcactaatgccgccactgccctcagcatgaagtccacaatccttaccataaccaacaagactctccactggctgggcccagcctgccttttttgtttgtttggagacagagtcttctctttctttcacccaggctggagtgcagtggtgcgatctcagctcattgcaacctccacctcctgggttcaagcaattctcatgcctcaccctcccaagtagctgggattataggtgtgtgccaccacgcctggctaatttttgtatttttagtagagatggggttttgccatgttgcccaggctagtcttgaactcctggccccaagcaatctccctacctcagcgtccgaaagtgctgggattacaggtgtgaccaccatgctcagcccagcctgcctttctaagcccataccctccgtaactcaccttagaccacccctcaccaaagggaagtcttcccaggtagagaagaaaagaagggcattccaggtggctggaacagcctgggcaagtactcagagatctgaaagagtctgcaagttcaaagaggcaaagctgagacctaagtgcaacgctctctgttctcatttcatttcctccatgctccatttaccctgtgctccaagccgcacatgacaactgtccattacctccctctgggcctcggcccatgtagttttttctctctggaatgccaaattcaaaagcagcatccttccttatccaggcatccttatccttatccttcaaagctcagctttgcgcagtatctgtgggctagactgtagtgggctggatgaagaattagtgaattccatccttattggaaccatctgcagatctgccttctccaccagggtgacagcattgagggatgccagtactgtcttacgcaccctcacgtccccaaagccaacccagcatggtatacagcaagcactcaatacatacgggttaagactagggccaaatttgcctgccagggccatatacattctgcatgagctgttatcaaacagaagggacagtgacccatttattgagatctatggggaaaccaactcatgagcaagaccccagcaaggctctcgggtgtgcaggatgagatgatggggtggtgcttccccactgtgtctggtcctgagaaccaccaggaactcttgttaataactcacgtaccccagactgataagcccaatgcttcagggaagagcctggaaatgtgtcctttttatcagactgaatctcacaaaaggtcgtaacttggtggttctgtccacgccaacgcagaacctgtcctctggtcagattgccagaggcacctggcctgggggctcaaagtagtaacagggctgtccacggcaggaagaaaccacggtaaagtccccagaggctttagtggcctgtctgcccatggcactgagcctcttctagtgagtcctgagtccaaggaacagcagatgccaacctctgagaaaaaaaggcaccaagagacttgaagcagaaatgataaagaacgcctcatgtttatagaaacttctgcaaactttcttcagacctctggtttacagagttggcttaattagaattcttggttcttaatatactttcatgatgttttcctgcatagccctctcttattaatattatttacttaggtttgctactttgtgttatggcatgtaattgttattttcattgatttattatattttgataagcacctagagatcttccataacaaccactccctgatagtaacagaattctgctcactacacttcatccctgcaatgatgtacaaagaaaatttgggctggcaagaggaccttcaggagagaccccagagcccgtttgttcctggatttctgctgcagtggttctcaaccccgctgcgtatgagaatcacctgggaccccaccctcagccactgatttatttgagtaggccccaagcaacagtatttttaaatcttccccaattatttctatcaagagcactacaaggactccttagagttctccctacccctaggcaggtgaaatataaatcatctaagaagtttctgggggaacagctacacagagctctacccacccgcccttataacctaatatactttcctaaagatgcccccccacttgctcaccttaggggatccctgcacatgggacccattctactgaagagggtgtgctgggcaagtggcggacatacttctcaatgtggggcccgggactgcacctgcaccagaactgggctgtttgttaattatgtgtggagctgaatcagcatctctggaggttgaggctcaggaatttgcatttctaacaggcaccccaggtgattctcaggcacgcaagagtgtttgaatggctgatgcagtgtcagggacaaggaaagttgagagcctccaggcacaactccagggctgccaagccaggtctgtatcttgcccattctgtgtctcagacacctataagggcttaaaggataaatactgagtggggaacacatacactccttgtattttaggcaagactctttttcttatgaatgacagacagacaccaaactcaaacaagcttaagtgaaaagaggaacgcagtggcttacttagctgagcacttcatgagcaccttcaggcaaagctggatctaggtactcgaatgatggcatcgggcctcctctctctccctatctgtctgtctctgtatctcagctgggcttctctctatgggtagtcaaagaaaccggccaatgacagctccatacacaggtctcacagcttaccaccttcagtataaaatgagaccttctgaacaccccaccacactgtccacaaaaacccagtaaagctatttattgggtgatttggttcacatcctatttcctaaatgaatcaatttggccagggatattggcaaggggaaggggtgtcaccataattgcccagcctaggtcttttgtccacctctctgtattgaggatgacagccataaatgacagctccatgaagactgaatggagtggggaaggggaatattctccaaataatctcgggcagtctggtggcactggtctagctctcttaaaaatcccttaaataggctgggcgcggtggctcatgcctgtaatcccagcactttggaaggccgaggtgggtggatcatgaggtcaggagatggagaccacggtgaaaccccgtctctactaaaactacaaaaaaacttagccgggcggtggcaggtgcctgtagtcccagctacttgggagggtgaggccggagaatggcgtgaacctgagaggtggagcttgcagtgagccgagatcgcgccactgcactccagcctgggcgacagagcgagactccgtctcaaaaaaaaaaaaaataaataaatcccttaaataagtggtctagagacttaaccagtcacctggggcctgctctttccatatggcctcgtcctctccatctgatgcttgttctaaccccccatacccagatagaccctgtgatttttgttgttgttgagacagggtctggctctgtcgcctaggctggagtgcagtggtgcgatcttggctcactacaacctcctccccctgggttcaagcgattctcgtgcttcagtttcccgagtagctgggattacaggtacgtaccatgatgcccggctagtttttgtacttttagtagagaagaggctttgccatgttggccaggctggtctcaagctcctggcctcaagggatccacccgcctcagcctcccaaagtgctgggattacaggtgtgagccaccgtgcatggcctaaccctgtgatttttatacaacctcctcctctgtaccaaagcatgttaccctcaaaatgttttcaaccagccagttagtctatcgccaatctagtgaaactgaactgtacttactctgagccatgcatgcaactaaaagcctatgtgcattatccaccccacaactctcttattattccccacttacaggagaagaaactgaggcacaaggaggtttgttgatttgggactgatttggttttaagttttgttttcttctccacagctcctggactttttaaaattcctggaattgtgtctctctatcatggggctggtactattaccatacgtttcagaaaacagcatctgtttacaaagcgttttattatacaacacagaaatacatttcaccccaaatgataacagtgaacttcagcccccagaatctccttctccccttcgtgaaacagagctgggatgatggcagaggactccagaacgcactgagattgttccttggcgtgacaaatggcaaaggactctagaacgcacagagattgttccttggtgtgacgggccagacagcacacctttcttcaagccattctcacatcaaataaaacgttgataaatcattgtttctctaagcttgaaaaatgctactaactcaagacaaggtgaaagtgagtttgttgaaatcaacgtgaaggatcgagggtaccaacttggaatgtaaaaccatagaaaataccatctgggaacacggaaatcatctgtcttatctggaagcctgtctccagagtggcaaacttagggactggtttgaggacagagtgtgccctgtgtgctggggaggggtgtaaaggactgggatggaggagggggggctccagatgttcttttacccataaatacactgtacatcaccgtctgccactgaagcttaaggattgaaaaccttggggatgtttcactggttttgcttccgcctctgcaatgtttgaacttgcattttctgagccacgtatgcaactaaaagccttacatgcattacccacccttcacctctcttactagtcctatttacaggtgagaaaactgaggcacaaggagttttgctgattcgggattgttacgggttttaggttttgttttcctcctgacagctcctggactttttaaaattcctgtaattgtgtctcccaatcatgggccaggaatatgagaatcagctgtgaacttcgagcctgtccatctcaaaactcttcatctccaagacatttcaatagagctttgccagtaaacaaaaataaatacggttcggtttacccagaggccaaatcccttgtaataagttctgggccagtttcttcccagagcgggagaatatacagttgtagtttgagttgattttatttctttgaggctttgtttttctagtctttcaggccttaacctcactccctcaggaacagctgaaatatgagaagagatcatatggcccccaaaaagtccccagattaaccaagattgatgccacccagggcccagttggggtcaacaccctgtgtcaggtgcgctctctgtataattcctgtttcctgtgagaagagcattaaaggcccgttaatgttttaaaatgaaatgcaacctcttaataatcaggtttctccactctgctaggattccaaaaaaaaaaatcagcaactgacaaatgttaaaaatttcctcgctgctaatcatgctttcccccgcttccctttctttccccctctcttctaacatgaatttattttctatttgaaagccaatctcactggttattagatattctccctgctgtcactatcagtaaattattaaacagctgaccaagctttgttttaaaatgattctcttatgaagctcagtgatatatttgctatgaatactgaatggtgccgcggtctctaaggtcacgtgaatgattcctatttactacctttagcaaaatgtgtgtgcaattagcggcaagaacttgacttgaatcacagttactagggatgcctgtagctcatttacatggagctccctttactcattacactcctgcccaggagaagcgtgttaagattctaggccaggtcacgaaatagcatatagacttgtcttttgtcattcctcacctcctttcttgtcttgccactgctgagccttgacatacctgtgggaatcctttgtttcatggagcagcgggttctaagtgaatttttgcttaaagaaaataaacgtgattgagagaaaattacttacctgtctgtgtctctgcgtctcatctataaaatggtcgtcataatttctacctcacggattctataatgagaacaaagtgctgagcacagtgcctagcatcgggtaaatatttgggaggtgatgggtacttattctcctgttgactgctgcattagtccaaactctcagttgtaagtgacagagacctatctccaattcacctgagccaaagaggaaacacagtggcttccctaatcaaacagtggttgaacagtcaaggtctaacttggaaaacagaaactgcttcaagtatttgcaacagaggggatttaatgcaggaaactggctacacagatgatgagagagctgggagaccaggaagggagaggaaggtaacgcacaaatacacgagcgcaagaagctactgccaggccgaagatggatggatacaggtgctggaagcctaggagtacatgaatgcatggaagctggaacgctgacagatgtgttcaggggaagctgaggccaaggaggatactcctttgctgctggagaaattgcctaacgcagagaaagaggaggagaaattcccttgcttctccttttcccctgcctccagcatccaatcagcatcttccattggccaaaccactggaagccagctgaaacaagagtctgggaaaatgaagccaccagggatcagcctctctgattacagagcagagcaaggaaaggaaaggcaaggcatgaatctgaaggcaaaaaggctcaggaccagcccggatgggaagggaagtgtatggccagccttagatgccagtcaaccttcacgaggactctgcctctacctcctttctctcagttcttcagcattcttctcccagcactgtttgccaatggcagagagcatgactgagggtgtgctcatatcctcctaattccatgttcagagaaaacaggaagcttttctcccagcaccaatttgaagaatcctgattggtcacatgcccatcccttgaaccaatgactgtggttgagtaatgaaatactatgacttgtttaacttgagtcatgtgctcatccctgttggcagagaggctagatttgatctgagagtcagggggaagggtgcagaaaaacaagagatacccccaaattagagtaggactattctctcagtggactaagtcggaaagttttaagagtgcaatggtcattagtcccgttcactgaatatttctaattttccttccagagacagagtaggatgacatttttctatctccttagaattaagtgtgacaaggtgacttgcttttgccaagaaaatgtgagcagaagtgatccatgttgcttctaggtggaagccttttaagcagtaatatgccatcttctctttgcttttgatacagcgattggcaatgttgtagatagtggctgttccagcagcctcagtcccagaatgagaagacatggagcagagcttcctaccggtccataatgggcatgtagtgtgtgccataaacaagcctttgtgttttaagccaccgcaatttgcgggttgtgtattacagcagtgtaacctgaactatcctgactgggtctataagaaaagtactcaaagcagtgattcttctgagctttgtaccaggggcagctgcccatcaaaacaatgctggacactagcctcaaacaaccaaaaatgttaatagaggacagtgaaagaaactggatagtacttgatgttcttggaatcaccaactactgccacccttcctcctctccctcataccagtcaacatatttgcccagctggaaaatgatggctgtaataaaaactaccatttattgatcatgtgccatatgccacacactgcataaagcatctactggcatactatcttgacaacaggtatgtgcaatagacccatatttcagatgtgaaaaccaaggctcacagcagcaatctaacatcccaaagtcacagagctggttgagctggaattcatcctttagattgtctgacttcagagtatgtgttcttttttttattcattggtttaaaacaacaaaattgctctcttatcatgtaaagtctgccatggtttgcacaatttttcaagggagcattccatgactgcaccacacctcccaatcaatagatgcatcctcacttgcacaggcagaagaagaggaagttgtagaactgtgcatctgcttttaaatgcatttgctcacattttgttggtcaaaccagtcacatgggcacacctagtttccaggtggcaggaaagcataatcctatcagatgcctgaaagggggaagtaaaaaatattggtgaacaataccaatggctaacattctgagtcagagtatgtatgttcttaacctataaaataatgtctcctttatacactcatatgaatatccccctgtctgaaacaatctgttcctatttgattatacctgcattgtcattccttcctagatgctatgatcattcctgtccttggtcataaaagatttaagagacctgattgagtagtattggtgacttgctatcaaatcactctaattgctggctccatgaaggccttgactctggctctgaagacaacacttttgtcttgacccttctgaccaagctctttttttgttctctagatctaaaaataggatcccaccttatacccttgtgtctgagcccctgcttaatattgtgccgtaatgccaagccctccaagatgggagacttgctttcactggtattccagggctcgtttcctggcacagagcactagttttggtttggcatttctacctcctaccaggcctccttgtagtgactactgaccttattctgtagttggctactaggttatgtctggaacaccccaccccagctggtctgcttcaactgtagctagtttagtccctcccacagttaagcaaactttacctctgatggaattcttgcaactgatgagaatgttacccatacttatcttaacatatatagtttgatcatctgtcatgtgccaaagtcagactatgtactagatataaattagtgaagaaaatagatactctcattgctttaaggagcttactttctaatgagaagacaaacacaagacagataattacaacagagcatgctgtacactgttatagaagtttctaaattgtcctgtttctacactcacagctccaagaacactgctttcctgcccctcctctttcctgagtgtatattattaatatatgcctatagagctggattgcagtactacatttcaccaatatgtgccgccacctaacacacgctgtgcccaagcccaaaagtaagcttcttttatttaattgttaaaccttggcaccggaaaccaactgagagttgatgaggcttgaccagggcatcagttgttgagacaaagagaaagagaaaaaaagaaggagtcaagaaatatttaagaggtagaaacaacaggatgtgaggacgagagaggggaaggagaccagttaaggaagacgcagacttcctgaaaactatgtagttaatacaaacaaggaagggtttaaggaagcccacatcaaatgctgagccacagtttcagttattagctttagctgatgagtttggtgtttcaaccataaaagtattttggtaataaaccatctcttatttaaatgacagtgactaagattgtctttagcaaactcataactagaagccatcaatccactaagtcccacagcaggatctgatccccttgcagctggcaggaggttagaggaaatcccccatgaatgtccctgaacacatatgattgctgtattaggccgttctcacactgctataaagaaatacctgagactgggtaatttataaagaaaaggggtttaattggcttacggttccacaggctgtacagggagcatgatgctggccatttgcttggcttctgaggagtcctcaggaaacttacaatcatggcagaaagtggaggggaagccagctcgtcttacatggctggagcaggaaagagagtggggaggtactacacacttttaaacacccagatctcgtgagaatgctatcatcagaacaacaccaaaagggtggtgctaaaccatccatgaaggatccaccccaatgatccaatcacctctcaccatgccccatgtccaacattggggattacaattgaacatgagatttgggtggggacacagacccaaaccatatcaatcacctactggatgctatatcattatctcactaattgtttccagttctgaaagcatgcattacaatccccatttcatggagaagaaagtagaagagtgataaatttgcgggactcttctatgctggaaataaaactatgcctcaaagaactcataacctttcaactgcattgtatttcctagaaatgtccaccagatttctgtaaagcaccctgaatccagcttgaagttgtcagcctttggcacctagaactgtttttttaaataccattcattggaagatataacaaagaaatggcagagccccaggaacagaaccttatatcttagggcccaacacctgatgtcagctgagtcaagaaggaccaggtggtaacttgagaaaagcaagtgctgccattcactttgatcccacaggcgtttacttattgaaaagtggatgttgaatttggaagccaggctcagaaaggcccaagtgcagaatctggttccaataagtcaatttaatattttaattaatcatcacattttccaacaggctctgaaagcaaagaaagagatacgctttatctattccttagaatgagaggaggttctatggagatggcagagttaagagttggtgctattcatcttcaaagggactcgctaacataacaaacacttctttctcaacttctgaatccatgaagcctcaaatggaaatactttctatctgttggaaaagcattccagtcaacggaatcagtctcttgacaaggcagtaattactggagcaattttagcaggtacaaaggcatttttagtagttttaattattcaagggcctgattaattatctagtctgtagatcagaggccaagggggggataaaacttatgaaaatggttaccatgacaggataaagggagaattcagccgccttcaaacagaaagctgctctctgtgactttgcagttacatgtttgtaacctgcagtgctcacagaggatggaccactggactgggcgcttatagtcctgggttccaggcctggctccaccgccgatctgctacatccttgccttattcactttcccctatcaggactctaaaattagtaggttcgggggcggggaaggtatagggaatacaatagatggtctctggacctctgtcaagtgtgctacattctatagttccatagggcttttttaaaagtatagattctattgaaattttttctgtggacaatgaaaatccagggaaagtttataagcacgtaagggctttgatcatattttgagttaggaagacagccaccatgtagggcagatcaacatggggagagactggtaaaaggtgacatgagccatgtctgacatgagtatgtttttacctgaatgtctgcttttgggcagaacaaaggccacccccgtttatggagcctttcacctccacctgtggccccatgtgaggtactgcggagacacaggctctgccttcagggagtttgccagagcaaggatgccttgctcagacggtagcccactgatgggtctatctggagaatgatgtcagaatattctggaagcagagacattgtccactttcactgacatggcaagtcagacctggagcctctctgtatgaaccttctctgcagatgcagtgatgaaaccacctcacaaacacgcctaagccctgtgtgggcccgatggcttcccttatggagtaattgccttacctccaacatcactcctgacatgcatgcctagcttttatccaggctcaagtggtagggattccatgtatgtttctcatatgagacattttcagtcaacgttgggacagttgacaaagcgctttccaatttgttctcttggttcctccagcgacccacagtgagttccttctggactccatctcctagagtgcagcacagaggttaagaggaagactatctggttcaaatcaccactttgccattccctggctgtgtgaccttggacaagttacataacctttttgtgcctccgttttcctatatgtaaaaaatgtactgttataaagattaaagtggagtgccttataatagactgatgaacgttcgtgcccctcaaaattcatatgttgaaaccctaatccaattatgatgctatttggcactggggtttggaggaggtaattcagtcatgagggtggagtcctcttgaatgggattagtgcctttatgagaagagatcaaaaagctagcgaggtctctttccaccatgtgaagatgcaagaagttagcaatctgcaacccggaagagggccctcaccagaagccaaccatgctgggacactggtcttccagcctacataaatgtgacaaataaatttctgttatttctaagccattcagtctctggtgctttgttatagcagccagaataactaagacatgtccgtacagagtacatgtactgtaaatgagagataagtaaataacaatgtacctttgtgcagttttctctgagtctataagattcagtcaccccattactaaaatgggacagtaatccttatgcacttattttacaaatgttatttacttaacaaatatttactgtgctcctattaagtgccagtcactgccgtgggagctggagataccacactaaataaaatgaggtctttgtctttgtagagtttgctttattgtaggtgcagggagcaggcaggacaatcaaataaatgtgcgatatggaaaaatagaaagcagatggatgtggtggtgtgtgtgttttaagatatagtggtcaggggcccagtgcggtggctcacacctgtaatcctagcactttgggaggccgaggcgggcggatcacctaaggtcaggagttcaagaccagcctggccaatatggtgaaaccctgtctctgctaaaaatacaaaaactagctgggcatagcagcgcttgcctgtaatcccagctactcgggaggctgaggcagaagaattgcttgcacctgggaggtggaggttgcagtgagccaagattgtaccactgcactccagcctgcgcaacagagcaagactccacctcaaaaaaaaaaaaagatatagaggtcagggaaggcttttctgaggggatggcatttgagcagtgatatgaatcaactgagcaagtgatttggaggcaaagagtggattccagtcatagggaagggctggtgaaaaaggcctgaggcaggaccatgcatgacatgtgcaaggaacagctgaggccactgtggccaaagtacagcaggagaggagaaagtggtaggtgagatcccagggggagactcgaggcctagagcacacagagtctcacaggccaggtcaggacatagagagtatcctaatgttgatactctcattggaagcccgcagtgggatttgagagaagagtgggatgagtacgggctgacatggacactagttacatagggcatggcagaatgtgaaactgtggtccaccacagacagacacaaggtgttcaagaagttaggggagagagattatttcagactccagagagcttcaagaaggcagcagcatctgagctaagtatacgttcaatgggaggaagccaattttcagatgaagaagcggcgagcatgatgcttatggggttcgtttgttgatttattcattcattcacttaccactggcccctctctgcactgcgtcctgttctaggtgctaaggatacagtggtgtgtccattttatccagcctggcccctgtcttcaatgagttcacagtacaggttgggtggagagaatagcttaggctggtgctaattcttgttaagcccctaagattccaggcttgttactacagcataacataggttgtgatctccagtattgagtgaggtgctggtcatgtgtcggctttcctaacaggtagatatttgtcacaaaggccatgacatgatgatatgccctctgattgagacagctccatcagtaaaccctctttacatttacaccatcatcttcaagaaaacctgtagtgcatttggccaccagtatggtaccaaggtcctaataacagttcatcatctcaaagaaaaaagtgaaaaacaaaactaaaatccatcctaagataagtcatcccaaagaacagcaatctagcctcagttttaatcaagctctttaaggagtgcttgctttgtgccagggactcttccaagggtttcacaataattaactcatttaatcttcgcaacaggctgtagccctgcacacacacttcatcctcactacttcagcacacactgcctgatgtccagctgccagctcatgcattgctctgcctgagacctttctcttcctgacagagcccacgttgcagcctgaatggcaggccaaaagtgtcagggaactaacacccccactgggcatatgcactcacatggcacatgtacattcatgcacttgcacacgaaagcagtcctcaattaaggctggcttggagttggtgtataaataccccacctccttcacccctggattacacgttttaccctgagttgtgtgttttacagtctccagagctccccagggggttaagctcaagtcacctgcagcggtaacttgctctttccagtcttcctttactactcgtctaccttcacctcccaattaactaattgctcttaaatctatgtctccgggtgttcccctgagggaaccagcttaagacacaaccctttctttgagggaagaaggtaccatgataatcatccttattttgtagccaagaaaagtaaatcagagttttcaaacttattgagagagagactgaataatttgcccaaagtcagagctggtgagtggtagatccaggcttcacacccaaccaccaggctccaagatccatgctattaaccccgacactctactgcaaaaacaacccaaaccactgagcacctgcctcatttcattggctttgtgagatatgcacgttggtgagctacatagataaatacacattgttccagattcatctataaccttctctttggagattccagcatgtaattcagaagtgtgtttgagaaggtatttgatgtgattttcaatgcagtggcagccacaaggtgattcatcagccagctctctttgacagtgaattgatctcccaggtcaggaagcaaacctcaatttacgtaggatgcacttggaatgcgtcctcacagtagcacatgggagataaagcacagtcaatgacagttcttgtcaatgagtttgttatggcaagaggggagatgtggggctttccggtctgagtgctaccgctgacactccagatgcatgctttttttttttttttttttggtatgataaacactttgcctgagtcttttagccctgcctgtcaattccttgacatttccaagtcctcttttgatccaagtatcttcatccaatagcacaaaagcaaaatgagtacttacttggttctcaggccatcaaccattcttttttctttcaaaatagatctctctgatttttcaattttgtttcgtgtccggatgagtaatttcaggaccatgaggttggtgaagtctgagcttccccactcagaatttcttgccttcctacaaaaagaaaaaacaaaaaaaaaaaagcccattgtagcaaattgtccgtgtgattcatttgttgcagtcgctgatgaaaaaatttttttcttgaaggtctttcgaagatcctggaccatgatgataggaaataaccccagaaagtgaggaaagcaaggcacaaaaacttaatattaattttattttgccattagaaaatcttattctttttgcttttggggcaaaatttgagctatagagaatgataaattgagaaatagaagatctgatcaaaactgcctctgctagcctaaagtttaatgttttaaaaatacaattttatttttcttatgtctaggttttctgttctttattcatacctttaaagaaattaaagttcatatggctggtttcttcctgcttctcataaaagcgatcatgctcaaccaacagctagaactaagtttacgagaaagaaaggagggagggaaggaagaaaagggtgaaatgggagagagggagagaaggaagaaaggacaggagggaggaaggaagagaaatagtatgtggaggacattctttccatttcaaaactgtaaccacctcactgactatctacaatgaaaattcagtgggcagtcgttcaatgcctcacttaactccatctgtgtacattcaacctcttaatgccttagttttagggcaggcccattttatccttttcatcatctcaggcacaaggtagtggtgacttcagtccagaaacagagtttcttagtgtacttcatgcaacacatctaccttgaggcacttctacacaaagacacttgctggattctgaagggctaggaagatgaatccgatactatgtcagtcaagagattaggttaggcctaatgtggctaagttatgccatgtgacaacccccaaatcttggtgactagaagcaacaaaaatttatttcttgcctatgccacatatctgttgtggaaacacagaagccttcaatctacagtgtcctcactcaaggatccaggctgagggaggctctatctctgttcttccatgattgctaaagcaagaaaaacgggatgtggagaatcccacactgtctttttcaagaccccacctggaagtggcacaagttactctgctcacatttgattggtcaaagtaagtcacatggttatggcttagttccaggaaataggaaaacacagtcctatgtgcccacaaaaggagacaattaaaatatttggtgaccagctgcaatggtttgaatgtttgtcccctctgaaactcatgttgaaacttaatctcctttgtaatagtatgaagagggtgggaaatccgactatgggatttgagaggtgggacctttaggaagtaattaggattaagataaagtcatgaggctggagcattagtcaatttataaaagaaaggcctgagctagcactctcagccccctcaccatgtgatgtcctgtgccacccgggaatctgtggaaagtcccaccagcattaagatcctcaacagatgtgcccagcctccagaactataagaaatacatgccttttctttggaaattgcccagtctctcgtattctgttatggcaacagaaaacagactaagactaacaaagccaaccagacatcgcattcttgatatggaggagctcattgtcttttaaagatagcaaagccaaaaaatctttttagcggttccctaggagaggagcaaactaaacgtcacaagctcaaaggcagacctcacccaggaagaagagccttggaaaataagctggatttttacaagaaaagatgagaaatcaggctttttaggtgcaaagaagagcagagcaaagaagagaggtcaagaacacgtgagttatgctgcatgagactgagtagtttgttctgtcgtaaacagaatgtgtacttagcaatgtataaaaattaagaaagatggtaggatcagctcatggaaaaattgcatgacaagagatatggtttggctgtgtccccacccaaatttcaccctgaattgtaataatccccatgtgtcaagggcagagccaggtggaaataattgaatcatgggggtggtttcccccatactgttctcgtggtagtgaaaaagtctcaggagatctgatggctttataaatgggagttcccctgcaaacactctcttgcctgccaccatgtaagtccctttgctcttcctttgtcttcctccatgactgtgaggcctccctagccatgtggaactctgagtctattaaacctctttcctttataaattactcagtcttggatatgcctttattaccagcgtgagaacagactaatacaccaagctatggaggtgggagttctttcagcagattgggccattcattcattcattcattcaataagcagaagtgccatccttggctttgagaatgtagcagcaagataatgataataatagataggaaatgacttcaaaagagactttgacaagagaattgagagatttgggtgaatttatgaggggtgaacttatgagagtgagttctggcatctggctttggagattcggagtatgctagaaccaaatacgcagagagcacggcaagaacaggtgcagggagagggtggatgatgggccatgtgatgagctgggtttgagatcggctgagttggaggtgccaggagtggcacaaggggtctgcccagccagcgtttccctacaagtcaccaggcatacggtgagccctctagtacacactctggtggtgggacctgatcctctgtgggacactgccctggcttctgtgggtagatcaccccctggcttttgcctctaacctcccacatctgggactgcccccagaaggctggctttgggctcctggagccactttgcccacacacacagagatgaagaagtgcctgggtgtttatgtctccttggagcatctgcagccaatgactgtccggtccaggagagcacaagtccaacttttgggacaactcctgaggcataactcatgcccccagagctccccacagggtcaggcagaagctcccctcttcaagacttttgcctgaaatcctgtcttcacttggcctcctccccttctctggccttcttccacccgcccccaacacacacccacatactggtttctcctgggagcagtttcttaacacttcacttgcaaacaaatctccatcttgcggtctgttttgggggaacccaccctacatccagcacctacagtgtgccagtccctttgaaggacactggggattcaaaaattgaataatacacagcctggttttcaaagagctcactgtctggtggagagacagatgtatacattgacaatttcagtgcagtatgtgaatgtgctgttagagtaagacgctaggggtgagcgggaggcatgaaaatacgggcgagggctcttgttccacccaagggatacagggaagactttatagaggaagtggcctttagactggatcttataggatacataggattttgctaagggaaaggcagggaagggcaatataggcagagaaaacagttaatcgaagtcaagaggcatgaaatggatgggaaatgggatgtggggagactccaagtagcttgctattgcaggagcctaatgggcagagtagacagtggtgggcagagaccacagattactgcagaagccatgtagggtgtagaattcacctttccttccctttctcacttcttcactccccaagtggtgaccgcagtatcactctagaagtgaacctagagctgttcattcaggaagcacacatgccctttaatctgtactcccagcccacagcagtctcctaggagtaggtctcgccaactccgggtccccagcccagaggcacttgacagcacccataaactttctctcatcaactgatgttgtagccaaagaaaacaggctcccaggaacagataagggataagcagaaactacccagtgcttgcctgggaaactcttcttgtagttcgagttctcccagaagtagactctgtgacaagaatttgagcacccaaaatctatttgggaagtgtgagaaaatacccatagaggaatggggaagtgaagcagggaagaaaagcagccaatacagggagtgttatcaagcacgtcacctctgtgggagatgagcacttactcccaggaatggaatgggactggtgtcatgtacacacctgaattttcccaccccagggacagggtaattggggtagctgtatcccaggtcccatcaatcactggctgagggctgctcccagggagtgttaattccctgaaaagcaacaacacaccagccaggcaaggaagtgcaggtgcagaaagtcggaagtcaggccactgtgccccgaagcaagaagggcaaggaagtttgagcagggcacccatgacgcacaccacccttcatgcttcttgttattctttcccagctgtgggagagaaacatctctaaggacctgattttcccctttctcctccatgtaaagtttggaagaagagtcaggaaagaacatcgccaatcaaaaggagggggccaatgtccatctaaaagccattcaagcttcattgtccccaactattttgggcgagtgtatctgccaactggcacagattcatttcctcactccataaagcaagtgagcaaaagagaaagctagttcataataacccttctacaaagtcaaagcataatctgactttgggtttctaaggaatctggttcttttcacctaaaaatgcctgtgtaaagttctactaaagcagagagaggtgcgcatttttttaataccaccaccattaaggaaacacaaagctttttttgttttagtccagtggtttgcacagtgccctgaggcctaggagctctgcagaggtgtctcgggtggatgaggaaggcagaaagagtttttttctgctctgagtccctctcttagtttgggtttccctagaagctgaccaagagacaaggattcaagtgcaagttgtatatttgggaggtgattctgcggtcaccacttggggagtgaagaagtggggaaggaaaggcaaccaacaaagggtgagttatcaatgcagttaccactgtgggcagctagagcctgtgccttctagggacctgtgtgagccagactagagcacaagctttggcaacatcccacctgaggtgtgcgggagctggggtataaataccacggctcccttcagtcattagttcagagctgcttgtgggggacgttgattctctgggacttccagcctgcccagaagcagcaaaacgaactctggcagccagaaaaagcccttgggcagggagggagtgacagggagcatgtgctggcagttggaatttaatggaagaagccaaaattttgcagaacaagagaatatgcaagagacatcgatagcatgggatacagccccctattcttagtcctctgagaagagaggcttaaatcttctgttttacatatccgggtggcactagagatacactaagaaaaaagaggttttaaaacctctggtctgatacaatgtacttatttcacaaataaggacttagaggtccagaaaagaaagtgtgtagcaatgtgaggaccagagctgagatctcttgagcgtcagaccagggcttttcccacgctgcacacattttggcccaagccaagttttgctgctatttcattttttcaaactccttttgttcacattgtccctgttctccacgtatgcccctgcgaccttagccgactgttgcccagcatcaaccactcgcgcttcccaccagtcacatagaatgccattctctttccatctttatccagcttctttgacaaaaaccttttattacatttgcaaacagtgaccaaaaagtatgaaaaccagaggattgatgttggcacaaccactttggaattaaatgtaaatactccacttcacttgggcgacatgctgggctgataaaacagcttctgcaaactcaatatcaaggagtctgtttccaatacagctgcctattgtctttcatgtttgaagatcattcaaaagcctttgggctgctttatacacgaacatgtggatgtcttaatttataaaaatcactgtgcatcctattaatctctgcatcttcagtacccaggactctttctagaccacaataagtgctcaataaatgttcactaaatgaatgaacaaaaaaatgacagctacgcttcccctcaaactgaaatcaaaaggccagccagctgcagggattttcatgtgcacgatgagcttcagtgacattccgtcaaaaattgatcacgacctctttgccagacttttcttgaactatactgacaaaaaaattaaaatcattccattcattaaataaatatttattcagtgctaactatgggttgggcattgggatatgatggtaagagaaataaaggagagactcttcctttttgaagagtgcagcccagacagacacaaatcaagtaaccataccagttaaatgacaccagccatgataaataacagtggtccttttaaaggtaggtccacaaagcctttgatgttcctccccttgagaggtggagctcaattcccctttcctggagcatagtttgaattcagtgccttacttgtaaggaatagaagagaagggatttcatttccaagactagtctataaaaagactgtggcctcatcttgggtggattcattctttctctttctgtctctcttctcatcatttgctctgaaggaagtaccagttgccatgttgtgaggatactcaggcatgtgaggggtaagggagaacccccctttagggaggaacaggggacttctagcaaccatgtcggtgatcttggaagcagagcctctatccccggttgagcctctccagatgtctgcagccctggccaacaacctgactgcaacctcatgagcgactctgagtcaaaaccacccagttaatccactcccagatgcctaactcacagaaactcgaaagtaataaatgtttgtggttttatgttatgtttggggtaatttgttacacagcaataggtaattaacatgaaggagaagtcctagataatgtgagtgcttccatctgatctgggaagtcagaaagagcttccccaatgaagtgattgagtaatggaggagcaagaaggctgagaagagtaatccaaggaaaagaagtgacatgtgcaagggccctggggcaggaagggagcatgctgagttggaaagattgaaggaaaccagtgtggctgctgctgcatggggatcaaatgggaaagtgatttggaataaagccggcatgagggggacctatccacggagggcctcaagacattgtccaggactttgatctttatcaagagagcaatggcaagtctttgaagaaacaggtatgtgacttgatcagacttgtatttccttcatgttctttcaactatcatctcttatcaaagcattcagctgacaacttcctctctctgggcatgttttgatttccacacagactttctgcaaataatggaaatcacataggcaaaaaaaaaaaaaaaccctctgcttataatttgcagtgcaaacttcatgctaactctcattttaccccagtggctgccagtcactctctatcagctataagagggcgagatagacaaggtttaggaaacgtaggatgaagtaaggggctcccttcaaggtgaatcccaaaaatcatatgccaacgttggggtgtaggtatatctgtgcagtttttaaaggacaaagtcgagtttttatcacattctcaaggggatctgggttccctagaagcagaacctgaagccaagattcagggtcatggaagttactgaggaaggactcacaggggaaactttcaaggaaaaggaagagaaaagaacccagcaatgtgtgatcttgggtgatatgtagccctggcctgatccccagggggacactggagaataatctatacacagttaccccatcccatggcatgaggccagcctcttatacccctacatctacatccctcagttactggctgtgagttgctccctacatttctggagatgatgtaagttttccagataaaattaagtatttttatttgctaaatatagcaaccctaagaaaagggcagctacgaatcattagcagccaatactcacagcagctcacggatggctcagcaaaggggatcttggcaggacaccaaaacagcgttaaccacaacctgtgaccctgaaaaggttcaaaaccctccatctataggacggaaatggttggctggtcagtaatgttctgggaaaccatgataaattcctcacacttagaagctgcaatagggccccaggaaactaggacagagctggcatccagttatgtttgcacatctgactgactcaagtttcccagggaatccaacccaaatccagaacttacagcttatcagagtacaggaagaagccaacaggccaaaattaacctaagcatcactaaactaaaagttgcacaaagattctacagaggaaccactgaaagttcagacaaccaggtcccttgtgttattttaagtgtggggtagtacaatgagagttaaaagtaaagattctggatccatactatccgagttcaaatcccagtgcccctgcttaccaactgtgtgaccctaggcaaactgcatgacctctctgggactcagtttcttatctgtcaaatggatattataataatagtctatctgtaccagtataggatcaactgaattgatttctataaactgtttaaaactgtgcctgcttcagagtagacatcaataaatgtttacaattaatatgattatatagttataaaaaatgatgtttttgttattaaagttatctgaaacttcccagattagctccttccaaaggcctgaaaacatccttcatactactgggcagcatcatttggccatgagcttcctgggggcctgatgagtgcccttctcatctttgctcggtgttatggacacattgttgggtttgatgaatatttgatcagtggaggctgccattgcaggaagtagccaggaaggaagtttgctgtcattcaggcctgccaggcccttccactccacccgcctttacatctcatggcaggtgcaactgcatgtttaaaagccatgacgggtcactctttgagcctgaaatttccaggtgtacagtcggggggttggtctagagaaaaatctctgaccaccatgtatcgagtcctccctctgtgccaagcactgtactgaatgtttcatgaacattaccttgttaactcatcccaacaaccctaacttcttaatttccctattacagaagaggaaatggaggctcagccaccttctccaggcagggcacgcagctagattcttttactctcaggcacgagccataatccagcaggaaggacacattcttgccaatgatggccaagctccctgagatcacgggagctatttgcaggcaggtgctgaagccaaaactcaagaagaggagacactcgtatccaggcaccctctagctcacagccagagctcatattctccaaagctgggcacaagccaagagagaataacagacacccccgggatttcatagggatgttgtagagccagggaggtagcagagctaataccacaagaatacaacagtaaatacagctgggcacagtggtgcacacctgtagtcccagctactcgggggcctgaggtgggaagattgctcgagcccaggaattctggactgcagcacgtcacggcaatcaggtgtcctcactaagtttggcatcaatatggtgacctctgaggagggggcccacaaggttgcctaaggagaggtgaactgacccagagagaaaatggggcaggtcaaaagtcaaaactcccgtgcagatctgtagtgggatcgcacctgtgaatagccacagcactccagcctggggaacacagcaagaccctgtctctcaaaaataataattaattaattgtaaacactgcttgctgagtacttattaaatgttaggcgtcacgctaagcccctgtcttggtggagtttccaaaaacagactctgagatgaggatttggctgcagggtgtttactcgggaggtggtcccaggaagcacagtgagagccagaaaataaaacaaagaagagataaaagtcaataaatggtacagtgatgaccaggtcacctctgtggacaactaaggcttggtcctactggggacactttgggaagctctgtgttacacacatgagaatttttccaccaagtgtgagaaagctgggtatggatccacccactcccatcttccacaggttgagggtccctcctggaacattaactccctagcacttctaaatgtcctgtgcaggggttgagcaccctcctgagcatcagaggagcccttgggcagagaggatcacaggtgattgaggctggaagccatagatgtgtgcaggaactgcccgggaaacgtgcaggtgacaagagagtcaagaaaacattagaagggtgcaacttactatagcctctttcaggcattgtctcaccagcccagtgaggtaggtacaattgtgtgtcattttagagatgagaaaactgagactgagactcagcaaaataaaatctactcaaggtcacagttgatgagctaagactgagtccaggcagcgaggtccagagcccctggtctaaggcatcatacaacactgaggactccccagccagtgctctttgactctaccgagcaggcaacaatcgcaccaaacccatgggattctagcctcctctatttgtttattttactgtatatatttaaggcacgtaacatgaggctttgatataagtatacatagtgaaatggttactagagtcaggtgaatacacagatctatcatttcacatagttatcctttgtgtgtgtgtggcaaaagcatttaaagtatactcctagcaaaaatcctgaatacaatacaatattagctattgtccttatgtggcacattagaactctagacttcttcctcctacacctctgcacctttgtatcctttgacctatacctcctcattttctctgcaccccttccttgccccgcccctggtaacaaccattttattctctgtgtattcaactttcctttaactccaaatcctgtatgttctccatacagtattcattctactggccagcggtttgaagtaagggatggggttgacctttattcgactggagtagaaagatgaacagagctggggggtgacttctttgtcctaaccaatgccaactccattttgctttgtaaaaggactcttggaattagtaggggaggaaaaatcacctccaggtcagaagcttaccttgtgtgtcatatttcagacaataggaaggaattaccccagtttccctccagcggggtggacagaaacttcccccacccgccactggaatagtatagtcagccttagtccccctacctcctgggaaatgcatgagttggatcccttttccaacgttctagttgtgtgaccttgcttatctaacatcacctccctgaattcagttttctcatctataaaatggaaatgatgactcttgcctcttagggctgttgtggggataaaatgagataatggagagagagttctccgcactgtgcctggcacatagtcagcactcaaaaagagattcattcctcacccctcacaatgcacctacccgtaatggggatgcactgggcaggtgtgacctgagagcatatgtttgtggtgacagatccagcaagacaataattgagagtaacctgcgtggtgtgtgtgtgtgtgcgtgtgtgtgtgtgtgtgtgtgtgtgtgtgtgtgatatgctgcactcaaaacccatcctttcccacctctaaccccatgggctctccacagtgattacagtgattctaaagaattcaccaaaacatgttataagccttgattacaatgaaaaagcgattttcctaaagtggatcttccatctgctggaggtagccaggccccagtgacaaagaagaaattcctggaactctgcaaactcggggtctgtggcacaaagcccactccttcctgcagccagcctgattgacaaggcccaatatccgtcccctcccgggcctagatccacagcagcagcccacagagcagccttggaaatggacgataaatggcgcctttttatttatgagcactttccattatgggcataatacccccattctttccctggtttgtatataaacatctcaaaataggcttattttaaaaggaccttgggacacaatacttctgtttgagagaacggccaacgtgcccacgcacgctgagagtggctgggttgttacttgctggccccctttgcaagagcactcggcagtctttttgggcagagaaaataatttgctcaggagcccatttgtccctggaagtcacagagtggacaaggtcacctgctactcgagattcacacagttgccagtcctggggttggcaattctgggacccatggccactgggtccatgataataattcacatttgcagaagtcacgtgtttccaaagccctggtccctggcttttgctcatttactcctccccacacttgagttcatagttagaattttttttttttaattgagacagagtctcactctgtcacccaggctggagtgcagtggtacgatctttgctcactgcaacctcggccgcctgggttcaatcaattctcccacctcagcctcctgagtagctgggattacaagcatgtgccaccacacttggctaatttttttatttttagtagagatggggtttctcaaatttaggctccactgccctaagaggcaagtgtcatcatttccattttatagataaggaaactgaattcagggaggtgatgttagataagcaaggtcacacaactagaatgttggaaaagagatccaagtcatgcatctcccaggaggtagggggactaaggctgactatactattccagtgagggtggggaacgtttctctccaccccgctggaaagaaactggagaattccttcctattgtctgaaatatgacacacaaggtaagcttctgacctggaggtggtttttcctcccctaacaactccaagagatccacccacctcggcctcccaaagtgttgggattacaggcgtgagccactgcaccctgcctgttgttagaattcttcagaggagaaaactttatccctgaagtattaaataccttaaccaccatcccagaagaattggcagaggtggagcttggatatattgtcaaaatggtgaaagttaatcattcatttgcaaatccacctgaaatcactatccttgattcgcctcaattctaatgtcactacaaagacctctttaccctcctcccactgcctcaccccaagaagcccattgctttgctgtgtttctctcctgaatgaagcttggggtctcttggcccagggcaagaaggatgggctgacccccaggggctctggccaggcctttacggagctaaaaaggatagcaccttttcccaatctcaatgcagagagtacagtgattttttgcttttgtgatctattttgaaagaccaggtataatttatattctatttagcaaagctttatatggcacttattgtgtgccagctgttgtttcaaatgcatttcaaatcttaactcgtttaatcttcataacacctttctgagatagatcttcttattggggaatttgtaggtgaggaactgaagcagagatgcttaagtaactgtctcaaagtcacacagccagtatgtagaagagctagaatttgaacttggcctggttccagagtctgtgctttcttaaccactacattatattcttaaatgatagtgtctataattcaggtgattacccgtggtcacttaccaggggagaaatgcctactttttggaaataggaagcaccaacattgaatgggctcctacgatataccaggctttgttccaagggcttcaatacgctatcttactacttttcaacaatcttaggaggcaggtgctgtaatctccagcctacaaatgaattaatcaagactaaaagcataaactagaataggaattttagtaccctgactggtagagggccactcaacaaatccaaatccaattaattaatgtctaagcattaattaattgcttagaaactcagaaacacagctggtatgcagtggagcctaaatttgagcccagttttatctgaccttcacctgaaaactgaccaggatatccccaggtaacacaattagacaggtgtagacagtaagttatttttataaaattatcaatattaacataaatagaaatgtattaatatgcatttataatacaatatacattcattaaataaatattaattaaaattgtagcatatagattcactgatttctaattattgaggataagaaattcattttcaatattgcttcatctaaccttaatgtttcttattttgctttaaagagtacatgtaactttgtctttttttatttttctatttttctaattttaatttttctagacacataatagttgtacatatctctgggatacatgtgatattttgatacacacgtgcaatgcataatgaccaaatcaggataattgggatatgcataaccttaaacattcatttctttgtgttagaaacattctaattcactcttatagttattttgaaatatacagtaaattgctgttaactacagtcaccctattgtgctgctgaatactagatcttattccttctctctcactgtatttttatacccattaaccaacccttctttatccccccaaccccattacccttcccagcatctgtgttttttttgcttgtttgtttttgtttttttctgagaaggagtctcactctgtcacccaggctggaatgcagtggagcaatctcggctcactgcaatctccacctcccaggttcaagcagttctctgcctcagcctgccgccagcctctgtaatcatcattcttctatctccatgagatcaattgtttaaatccacatggaatttattttggtatatggtatggaatatacttttataaataaagcacatatacatatatataaataaaattatgcatatctccaaatggttaactgtctcaccatcattaattgaataatccattatttttccccaccttactcttatagtaaattcttttttagctttctatttgaaatcattttaagctttcagaaaatttgcaaaaataaaattgagagttcctttatgcctctcccccagcttcccctaatgttaagaacttatgtaaccatagtgcaaaaaaaaaaatggaaaattaacataactactctgcagaccttatttgattttcaccagtttttccattaatgttctttctctgttccaggatccaatccaagatcctacattgccttgagttatcatgtcttctcagtttcctccaatcggacagttccttggtcttccatctttcatgaccttgactctttgagagggtatgaccagctactttgtaaaatatcccttaatttgggtttgtctcatgttttcttggggttagattgagggtatgcattggaggcacaaatatcatacaagcgatgtgcctttcacagtgcaggagtgcatgatggtgcaacgtaccaggtggtacatgatgtcagggtgtcccatcacctgtgatattaaacttgatcacttggttaaggtggtgcctgccaggtttctacactgtaatgttactatttttcctcttagtaaataataaatatcttgtgaggaaatactttgagataatgcaaatatcctgttctcatcatgctaaatactaattttagcctctgttgatgtacttgcctgtgaccattgttatcgcagtatttgcctactggtgattttctatttccatcattcctctacaactattaatcaaaattcctctgcaaggaagaactgtcccttctcccccagtacatataattatttatatcagtatggatttatgaatatcttccatgggttataatccaattcttacagtaaattataacatacccttttttctcttgctgaatttactattctatttcatgggtattttggtatattcctgccccaataatacactatcttcatcattacagctttataatacatattagaatttttacattcaagttcccttctcactgtcattatttttccaaaaattcctgggtggctttttcctatttatctttgcagatgagtttttaaatagttttgtcaacttacacaaccctaagggcattaggttgaaattgcattcgattcaagaactaattttgggaaaattgttttctttacaatactgtcttcccattcaaaaacacgatatgcctttccgttgatttaagtcagctttcagatgcctctatgaaactttgccatttatttcatataggtactgtaccttttggttggaaaattcctagagtccttttccccccccaggattttttttttttttttttgtgaccagacaccttattgaactattttattggttctaaatttttttttttttttttgaaacgaagtctcgctctgtcaccaggctggagtgcagtggcgtgatcttggctcactgcaatctccgcctcccaggttcaagcgattctcctgactcagccacttgagtaactgcgattacaggtgcgcaccaccacacccagctaatttattttttattttttgtatttttagtagagatggggtttcaccatgttggccaggatggtctcgatcttctgacctcgtgatccacccaccttggcctcccaaagtgctgggattacaggcgtaagccaccatgcccggcctggttctaaattgttagtttattaatttactcaacagttacctattgagcatctaccatgtaccaggcactgatgggagaaatggggagtcaactttgttctgggcctcacagaccctaaattctagcaggtcagacaaagaacagaaaaacaagtaaatacttataagtaggactgttatttatcataaggcagtattcagtgctctatacaacactaaagcaacattggaaaaagcaaaatgaaaggaagagggtgttatcttagacatggagattgattgggaaagcctctctggaggggtgatatttgagcaaagacctgaataaaatggaagagtgagccaagaaaccatctgagcaaagagcattccaggtagagaaaatagcctgtgcaaaggtcctgtggcagaaacgagtttggcaggtttgaggcatggtaaggctggggtggttggaacagtgtgagggagtgcagagtggtgggcagagcgcaagccatgtaaggccttgaggccctggtaaggagcgtgtagtgtagtctaagtgtgatgagaaacacagaagcagggattccagtaaggaggccccagaggtcatccaggtgagagaagacagtggccaggaccaaggcaggaaacgcggaatggtcagaagcagtcaaatctttgacacatttttaaagctgccctggcaggactgctaatgggttcaatgtcgggagtgagggaagatgagcatgatggaaatgcaccaaatccacactgggcatatatttcatgccgctcacatttatcctcaaggatccagactcagccaacactttgtaacactcatatagttaatgcataaggtcatagctaatttaacagactgctctttgacattaaaaaggaaaaaaaaaaaaaaaagaggccaggtgtggtgactcaagcctataatctcagcactttgggaggccaaggtgggaggaacacctgagcccaggagttcaaaagcagcctggacaacctggtgaaaccccatctctacaaaaaaatacaaaaattagcatgcatagggtggtatgcacctgcagtagcagctactcggaaggctgaagtgggaggatcatttgagccctgccagtcaaggatgcagtgagccatgattgtgccactgcactccagccctgacaacagagcaagaccctctcttaaaaataaaaataataaaaaaaaagcttttaaaacgctgctgccaccaggagtcctgtactatcagccatggtcaaccccactgtgtccttcgacattgctatcaacaccgagtccttgggctgtgtctcctttgagctgtttgcaaacaagattccaaagacggcagaaaattttcatgctctgagcactggagagaaaggatttggttataagggttcctgctttcacagaattattccagggtttatgtgccagggtggtgacttcacacgccaaattggcactggtggcaagcccatctgcagggagaaatttgatgataagaacttcatcctaaagcatacaggtcctggcatcttgtccatgacaaatgctggacccaacacaaacgattcccagtttttcatctgcactgccaagactgagtggttggatggcaagcatgtggtcttcggcaaggtgaaagaaggcatgaagattgtggaggccatggagtactctgggtccaggaatggcaagaccagcaagaagataatcattgctgactgcagacaacttcgataagtttgacttccattttatcttaaccaccagactattccttccgtagctcaggagagcacccttccaccccatttgctcgcagtatcctagaatctttgtgctcttgctgcagttccctttggattccatgttttccttgttcccttccatgcctagctgtgttgaagagttaagtttatgattatgaaataaaaactaaataaccaaaagaaaaaaaagacaggctctgttttttgggcctgttttgggccataaaatcaatctccctactcctggggataatcaagatagcagctgaattatgttgaatatgctgtgatgtaatagagagaactcagagctaggaggcaggagctctgtgcaaacctgagcacatcactcagcctctctggcctcagacacctcacgtacaatgaaaggatcaaactggatcccctggaggtttctcctagtccaggcattcccgactctctataaactgcattatcacagggacctgagtcaaggacagcaactaagactcaacaagcaagagatgagagccccagttccccacctaaagcccaccacatagagcagagctaagaagattaaatgagaaaatatctggaaagttctagcagatgagaagagctcactccacaagagctgccaacacatgtctagttaacagagagttaacaagtatatatagatcaccaattttcaactccattatacttgtcaactgaaactctactgaacacattatattttattgatgactcaggtacccttcaggctcatgaaggagcctgaaggtcatgattataatctctaattagctttgttctggagctgtgtgggagggctggttaaccagaagttgcagatacacgagttctggataaagaattgctacctcaatggatgaagaacagattttgttcatttactgaagtgcttgttaattgtgaataattactggagggtgtactttagccatcacctacacatataaataaccatttgttccatgactccaggttattaatacgctcccagggccgttctgatataatgccgggagaaatgtgggacttacatcctcaatgtgaatatttgtttggcctgacatcagaggatgctaggaaaaaaaaaagaaaaactctgctgggatcaggttaacctgaattagtgaaggtttgagcaactagcatccataatgaaaactgcttaaggccaaggtatttttggaagctgccccccacccctcaacaaaggattacaaaagaattaaactctgggataccttagattcaaagcaggcctcccactggcttcaaagacttgggcctcctcattaaggagaaaagcaagagggtggtcctgatgtttaccaactgtcctggacctggcctcccttgtatcatatgctgggcttaaggggattaagagcgagtgagtggtgcagaggaatgggccagacagggagaggcagctcagacccagccatctcaccagacagcaggttctacacgtcccctagaagcaaagtcagcccacttcatcccttgacccaccatcatccctgactcctgtggccactctcagcttttctctgtcatctcagggctctgcctggaagtcccccgtctgtgcacatcacctcgctccctgaccagtgtccttccttacctttagctatgccatgtggtgttgtttgaattgtgtccccctaaaagatacgttgaagtcctaaccccagttccctgtgaatgctaccttatttggaaatagagtctttgcatatgtaattagttaaagtgaggtcatactggattaaggtaggccctaaattcactatgatgactggtgcttttatgagaagagatgaaaacacacacacacacacacacacacacacacggagaacattatgtgatgatggagagggactgaagtgacaccatctatgagccaaggaaggccaagaattgagggccacccccagaagtcaggaagaagcaaggaagcatcctcccctcgagacttcagagacgggatgtggccctgcagacacagtgatttcagacttctagactctggaactatgagagaataatgttttaagccacccgtgttgtcagctgccttaggaagttaatataccatgcaatacagccacattcaaacttttctgttcagccaccctttcttgaaataaaagtttacaaggaagtttaataagatattggaagaactctgattaatgtaggatgtggagagggaggagtgagcaggatctcaggcctctgccctccccttctctaactccgaagctaggggtagggcaggaaggaccatgccccacatccctcaggttccagaaagcagtttggcatgagaattagcaggcaggcctacagcacagcttctcctggacttgaaattcagctcttccccatcccagctgtgtgacatttgacagataacttattggggccctagtttcttcattagtaaagacaaaaccacctgcccaatgcagtcactgtgtagccaaatggagatcctgtttgcagagcacccaccctggccctatatcataggtggaaccatgtccccccccccaaattcctatattgacgtcctaccctccagtacctcaaaatgtgattatacttggaactgagggtctttaaagaggtgattcagttaaaataaggccattagggtgagctctaatccagtatgatgggtgtccttatgggaagaggagatttggacacaggcaagcacagagggaagaccatgtgaggagagagcaagaggtaactatctacaggacaagagaagcctcggaagaaaccagatccgcctacagcttgatctcagacttccagccaccaaaactgtgagacaatacatttctgttgtttaagccctccaggctgtggtgctttgttatggcagcccaagcaaactaatacagcctggtacacaggtcatgcaagaaatgttaatttcctctccattcctatgtgccagactcacccacaagcatatatatatatatatatataattttttttttttttgagatggaatcttgctccgtcgcccaggctggagtacagtgacgtgatctcagctcactgcaacccccgcctcctgtgttcaaacaagtctcctgctttagcctcccgaatagctgggattacaggcgttcgccaccactctcagctgattttttgtgtttttagtatagacggggtttcaccatgttggccagcctggtttcgaactcctggcctcacggaatccacctgctttggtctcccaaagtgctgggattacaggcatgagccaccgtgcccagccactggcaagcattttaatctgtcacatttgattcattctagatataccttctctccccatgtcaacatctctgaaatgcgggtgcatctggtagtctctgggagccaggccaggtgggcaccatggcacagttgtcattgccatgcatgctcaagcccggtggggattccctgtgaataagggcagctcccacatttgcaccagcaaacgacttacagatcattgaaggaacacaagtcctgggtgccctctgcaaaccttctatcaacacctcctggtaaattccaaaaattccagcagcaaaatttgcagaatagggagcttgggggacaaaaaaaaaaaaaaaaaaagagagagattcggctaggaatggagaacatttctaagaataactgcaccgtgaacacccttggtggcactaaggacaagatgacgcagaaaagtgcaggcatcgaccactgagtcaaaaagtgattcagagaaattgaattctgaatgtggaaaaggtttaggaatccttccatcaatttattttgcttatatttcccttttaatgtatgcgaatgcctgatatatgatagaatctatgtctaaatgaattttaaagagctctttcaacaagcataaaataaaaattctaagtgataaaaggtatgaactctagtttacatagcagcatttttttctttcttagtgatgcagaaactaaaagtacatcttacagttagtggtcaggggctttagtttgatgaaatatggtattaattgccacagtaattttaggcttgaggtatggttatccccattttacaggtgagaaactgaggctgagagcctacatgagcccagcatcacactgctagccacgccaggccaggattgggagccagccttgtacctacagtcccttgccacctgtgccagccctctcaagctcaccttggctgcccccaacctaaacctgaattccaatcctgaatccagcctctggcaggaagttgttgccaggcagttaaattagttggtttttcatgcatatataatgaacccttagcagtaaataaggcttttatgagtggcagatttatccatttttatggtgcaaaaggaaaacttgccgggtgtatatttctaacaggtgctgcccctcacacctgcatatgtaaatcacagtcgtgtgacatggaagtgtgggggacccgcctggaggcctgattttcaagactgtcaatagtcccagcctaaagaagcctgcattgcacagggcagaatctactgggagcactggggtgaggactacttaccagacacagctcagctactgcgaggtcataaagataatgttccagagggttcgcgtggtccccaggacacggggtgtgggctttgcaaacagacatgaagtatgtcactgagagtgggaagggaagagagagaagccattcccaggatggcaggcagagcaggaatccacagggcactctggaaggaagcaaagtcttggagtctaggctttgcatcagaatcatctggaaggcttgtcaaaatacagatgtccgggctcgcccccataaatgctgactcaggaggtctgagctggggcctgagattctgtatttgtcccaggagatgctaaaattaccaatcaatgaatcatgctttaagtatcattgctcaatgcctagattatattttgatcaaaggcacaaatatctcacatatgatctggtgtccagaaacaaccagcagccctcccagggatgtgatagcacagtgtatccaggtgtgaagagccagcctcgggcagcctggtagttaggagcatggactccagagatgcccggagaactcaaggtaagttgcttgtcctccctgaacctcagtttcctcctctgccaaatagggtaataatagaacccctcggataagcttgttgtgatggttgagttatgctaggcagggttttctctgctcagtaattgtgaagccaagtgatgggtcgaggggcattaattgtactattatcttcatcttctgtgttttttatttttataataaaaaaagtatttttaagaggcaatgcttgtacacatacctagctcacagaaggtacatttctattctctgtcccccaactctggcacatgccaccccccaaaagtagcctggaaacagcatctctaaaaacaaatgttcatatgacaggaagtggggacaggccaactaaaggaagtgctgggtttacttgcatttaattttatttgcttcaaaaaataaagagtaggagtgatgaggggaggtttggataaatgaacaacatcttccactgcctctttctgcttctattgtgatctcttgctctctgtgagtctttcctcctcatcctctccctccttctctctccttctctccttttctttccctcttatccctccttctccccctccttctctctttttttctcttattttcgacatatgtatctgtgaatctgtggaaggaagcgaaagcaatttcagaacagcaatttcagtttttacccctagcattagcaccctactcccaacatttccgtgcttgcttactatttttgtgggatagtcttgcagagtggtggaaagagcccagaattaaatcagacacccctggatttggatcctggctcagcttctcaccagccgtgtggccctggataaataaaccctcagaatctcagtcccctcatttggagaacgcaggtgacatgtttgggttcccctgagagcacagcctgagtatattcatccattttctattacttatatcagaatacctgaaattgggtgatttatgaagaaatagaacttatttcttatagctgtggaggctgaggagtctaagactgagggcatgcatctgttgagagccttctggctggtggtgcagagccccgaggtggtgcaaggcatcacatcatgaggggcacttgtttgttacagcagcaagcataacccaagctaaccttccctgcccatggagaactctctgccagtaagagaaatgaggcattcacccaagtgtcttagtacagagatgacttacaggaacttcagactctggaggatgatttctcacggtgataccaggctgttctgccatgtggcacaactgcaggaggagccattcacattttctatgtgaacagcactccccgtatttgtacaacctgccaccctgggcaggattcccagaggagtgggcctgttgctgagactccaaggatgagtaggaaccccacccatggagatggggaaaagccactgcagctggatgaaacagaagggacagagacacagcatatggaaaaccagaggcatgcatgcgtgcagcagtaatagccaccagtgtctactgagcaggaacgataggccagacagtgtgctaagctctttacatacattagctcactcaatctcacaacagcctgtgcaaattcagacactctggctccagagcctgtgctttaaatcccccaacagatcctgcctactatcactaacattggtacagcactttacagtttacaaaactcttttggactcatgatctgttttcattatggcaacagagcaactgttcccattttacaggtgaagaaacagtactaacggtcttgtgacttgtcaaggttacacagagagtaaattgagaggccaagacttgaaccccatcctctggccttagacaaaggatgccacagcaaggtgtctgcaaagcagtctctttcttcctccctgctctgcagggaggtgaggtgtctatatttagatcattacaaggagctgctgagagaatgtcctcaggctatgaattcagccttacacgcaaattcactgcagatccaggagaaggccaggaataaacgggtgggagaaggtccttgactccaaacagaaactgagctgatcaaacacagcctgagcacacgcagaggctgcaggagggaaacgagattaatctcaaaccctgtgtactcagaagctttccccagaacccaggtcccactggcaggaaattgtcacttcgtgcatttgtttatttttcccatgtcttctgccaggctccgtgtttcactgagtccttatcttctctgtgcatgtccacaggctgctgggttggaaatagcccaaagccattcagaccatttcaggcactgagttgtatcaaggatatttcttgtgggtagagcaaagatacgctcccactctccagttgggctcactgaggcctccccctattggggaactggctgggctcctctggcagagatgcctgctacttatcaaaaatgcacgttccccccactgtggtatagagttgtctctgagaaacacagcccaaccaggaactacatttcccagctaaccttgcagctaagtgaggtcatgtgacctgttctcaccaatggaatatgaacagagtgataggcttctcacctgggcaaaacagagttgatgtgctttctccacattctcgctcagcttctgcctggattcagaccctagggaatggtagagccacaagatgaaagtaaactgggtacccataaagagaaaatacttgtgttagtttactaaaatgatgagagttatttgttatagcagcaagcataacttgaattaatatatcttccttcctgactcttggcaactttagctccccatggagacaggggttggaataccacttgttcccccaaagagagctgtaatctattgttccctgttgtgtgctggcttcaccctcacacctggtttcctgcctcagttttcctgaatagaatagtagattccccttaagacagaggtgactcttatccaagtccatttgggactgactgcccagccttggtcaacatcaaaatgcgctaagactccagtgttataattaatgtccacctaccccccaattcatgtggccactgctcagcaaccctgctactgtatttgttccctttgaggttgctactggctgggtttgggccccaaacagtctctagctgtactggtggcttgataccagaaacttgggagaagaatggtgtaagaggaagagtgtattagtccattttcacgctgctgataaagacatacctgagactgggcaatttacaaaaaaaaagaggtttaattggacttacagttccatatgactggggaaaactcacaataatggtggaaggaaaggaggagcaagtcacatcttacgtggatggcagcaggcaaagaggggatgagaatcaagggaaatgggtttccccttcccaaaccatcaaatctcataagactcattcattcactatcacaggaacagtgcgggaaagacctacccccataattcaattacctcccaccagatccctcccacaacacatgggaattcaagatgagatttgggtggggacacagccaaattatatcaaagagcatgctatacaatcagaagaacctcaaaccaacctacaatttccaggatgaagttgtgctcctctattagaccaggaagctctctgtgcactgcccttgccaactgttcagtcttctccatctactttctcccaactactccatatactttctccactttctgctctcccaaatgtatggcactacctagcaccctacagccaagcatatgctgttccctccattcagaatgcccttctgacataaagttcagagcctggcagggggtaactgctggtttttgcctattcagcatccctccttcttcttctggaaacataaacccatgtggggaacctaacccatgaggtttaattagggttaaacctacttccttccccaccagaggagtaagcatgaaattgtttgggactgatctaggaaacttaatattttgacaccaggaaatatcagatctctttttttcctaagatgcatgaaaaatttaaacttaggttcttcagtaataatctgtatttgagaatggaatttaaaagtagacctcatgggagaatcacatgaacccgggaggcagaggttgcagtgagctgagatggcaccattgtacttcagcctgagtgacagagtgaaactccatctcaaaaaaaaaaaaaaaaagtagacctcagaaaagaggcaagagataaattcctgattcactgcttgagcaccttgtgtagacaatgttggtacctcacccagactacctctacaaggccagtgcacccatctgtaagtgtcaactgggaactgctaacagcttatagttgtacccttgtttaaagacttgcctcagccaaagagagccacttttcccagaaattctgaaaaggttatgctccccatgccagagggagctcccagccaatgcctgataaacacgggagtacaaaaggcgaatcctcttgctttgcagtgagacagcactgtgatgttattcctactccggagatcccaatgggaccaggctgaagctggactccagctgaaaacacattcttcatcagcttcttctcctcccctgtctggcataaaaagtcacttccttgcagttactgctgaaagcacctcctcaataaatcacttgcacaagaatccccatcacaagttctgcttgtagtgaatccaacctgaaatacccctggatcaagccatgcctgaagtcaggccatggacttcctaacccctagagcacacaaattctcttttttacttaagctggttgaaatcggctttctgacatttgggcttgaccttggagacctcatatttagtgaaaaataaacattcctgcagtgtcctttattctcaatctcaccttcatcatcagcccagagtgaggtaagcctgcagcctgctggctccctggacagtcatgtgcctagcctatgcaggcagacacacccccacacccaacacctccaagctacaaacagaaactgtcacacctcctcacacacatcttggtaactttattcagtgtgtgcttctaaaaagagtttccagatcgggccagatttcaactgcaataaaaaggaccaactgcttagcctctctttggtctgtgctgaatacaaataatacttgtatttgtaataaatgtttagagaaaaaccgcttcagtcctcggctttagagagttgtgtgcctttcaaggattcttgcatctgactgttataatgcagagattgctggctattaggatctgtcctaaaatcctccaagatgttggcactgtatggtattagaaaattatggtgttttgctgtgtcgccacaaaaagaaagattaaacataaagcagggtttaataaataaagctgaaggttgctgagcagaataagggagactactcttcattcctacggccaatgcctttaaatgcccagaatgaattacacatacgccaaactccagacccacccatccccagcattttcagtccttgtctctccaagataggctgttacaagtgacttgggtgttaatgtgtactgtgaatttcagttgacattgggtttaaacctcaggcttttcatccaatttgtgtacatgcattaaagctgctatttattgatattatcttgccaaattcctgtcaagccaataaatcattattatcatcctcattttacagaggaagtatcccaagcatagagaagttggataacctgcccaagggcatgccatcagtaaatgatagagctgagatgtgaatagaggaccctctgaatccaaaagacatactatgttcataaagctatactgccctctgtgtcaaataatataatgtggatttatctttcttccctttaaaagtttgataattttgtatggagcactgtgaataaggctgacttttgtaataaagattatctttctaagatgaaccttttaaagtcaaggtggccacaagtccccaggaccagaatttgcttcacggtggccccagagcaggatgcacactgagagccccccacgtagtgcccacttggagagcaccaggcaggggacccaggggtcaggggcaaactgcctcatgacctcagaagggcatgtgaggatccacagttcctgtcatccctgtgccatcctttgctaagacccctgctttctttctcatctgtaaaatggggatcataatgcctccctgggggtcggttttgagagttaaaacattgtggatgtgagagatcttagcaaagtgtctggcatataaaagctgctcagtcatgtttgcttctgaatctgaaggggtccagaatacgcacttaatagatgagaaactttaggcccagacagggagcaagacttgccacagccacacagcaagtctagctagaagctctgttgcctctaagcccaaggcttcctcctcttcctatatccactccatcctgaagctggggcagagtagctctgtctttactgtgccatacccaatacctcccagggaaggcagtttatgcacaggcctcctgacactgagctagcacagtggggaggggagcagggggcgagatggcctcgattagcaagaatctccctgccttcttttatctggggtggggactccaactgccttttgccagtgtgaccttacctgctcccttcaacctaagcagagggcagacacctggatagagcaggggacacccactgggcagcgagggcagatggttgcaggcaggcaagcatctccaggaggcagaggccaaacaacaaatgctaaatgagccacttccccccaaaactctgggcatcccatgaatcccaagctctgctcctctcacacattattttttcaaaccagtttgtccatcagtccaagaccaaagggagtctcgacccttagcccctgctcattggaggctgcccctgaatcaggttcgccaaatactcgccttctcactccaggtccaccaccatccccactgccaccccactgccctccctgctcaaacctaatctcattcctgattaaacttcctctcccttccatttgtaatcgtgtgcagagatgtgagttttgaagccccgtataaatatgtgctttagaattaaaggttcagcaattcttgacaatgatttctcagaaattaagcctggacaatttgtttggctggagcacaacgtctgaaacatgcatgatggaaaggcggtaaatgtactcaaagcccaacagcttcataaatattggctcctctgagggcgggcatgcaggctcacaggaacatgctgccccctggcagtgctcagggttagtgccagcccagagcccagaatctcacacatcctccaagtgaaacaaaacatcaccactcctgggcgcaacccagccgcactttcctccacttggagaggaccctggggcttcaacaggtggaagtaaatttgtgaaggagggaaaagggtgggataagtttttatctgtgtgtctggggtagcaggctctgtgcagcatgagattaaaaaggaatggaatactaatgcatgctacaacacgatgaacctcgaaaacattatgctaagccagacacaaaaagcacatattgtatgatcccattaatatgaaatgtccagaatagacaaatccatgcagacagaaggcagattagtagttgccaggggctgagggagggaggaatggggaatcactgtcaatgaggtttctgtgtggggcaatgaaaatgttttggaactagacagtggtgacggttgtacaacatcgtgaatgtacttaatgccacggaattgcacaccgaaaatggttaaaatggtacattttatgttatgcatattttgccacacacaaaaaaattacaactgggtgcggtggctcacgcctgtaatcccagcactttgggaggccaaggcgggtggatcacgaggtcaggagttcaagaccagccttgccgagatggtgaaaccctgtctctactaaaaatacaaaaattagctgggcgtggtggcagatgcctgtaatcccagctacttggggggctgaggtagagaactgcttgaacccaggaggttgaggttgcagtgagcggagattgcgccactgcactccagcctgggtgacacagtgagactccatctcaaaaaaaaaaaatcacaagaacaatctcaagtctcatttcttgccctgactccccgtccaccccctcagcatatctcaaagtcctgaacatttctgagtgtccccagagggttttttgctgacctgtgctatctgccaattccttctcctggcaccaggcttgctgcagccctgtcccctgcacctgccaagagcttccatggctgccacctggctttgtggagcagctgacattggcaagaggactgatgtctgccccaagagtgtcacctcttctcctgcaggagctgttggcatgaaagctgcggattcctcgtgctccagcctgtggaggtttctcggtggtcttagtatggctacctttctagagagcttaggaatggcccacaagcggggctggaggtctgcttggagacagacactgcatctggctcagaagctcctttctggtttgatctgccatcctcaaaccagacttgtggatctagaaaagatctccccaggagctcctggaatccatcttttgacagaaccctggcaggcctgtccccttccccatccccatcttcttgacacatcaaatcccaggcgagcgcttgtttagtattttatttaatcctcatgcatatatgaaacacagattcttattcccactttattgctgaagaaacaggctcaaaaaacaagagccacacaggaagttggtggcagagtcagaattccaagcctggtctgtccaaatttttcctggaccccttgctgcctctaggggcttggttcccataatacagcaaggatcagaggcaaggagaactctgggagtcataaactacctctcccacaagcctgggagctcagagagggcaggagtgggagattcatctttgctgcccagggccaagcacagaagcccccaagttagagacattagtgattgtttgctaagatgaactgggctcagaccccactgaggctgagataacagaatggggttggaagagaaaaactgacctgaatctttgcttagaacttaagataaatgatgagttaaaactggttgcggggtaggcatcttactctctctcatcaactttggttccaggtcatacacaaacacacacacactctctctcacacaaatccagcctcaggttttcaaaacaagagattaaagatatggttcttaatactcccattgtactacccatctactcacaccttgagcagtcaaaccatttttaaaagggctaaagaattgctcaaaattcttagattcaccttaaacagttagaattaattttctctgacacacgttgaatgacagaattgggtttcagaaatgatcccaccaggtcggggtggtgggccaaactgaacaatggagttcaggaaggaaaaatatgaatcccacactcagttcaaaaactgtgcaggtatcagatggacaaagtgtgacatggcagtcgagccacggtgtgacttgaatgcccaaactgtctgattttatgttggacaatataaatgcaagtacggtcctcaggatgagggaggtgagagggcctatctcctatcaacagttcagagcatgctgaggtctttggtaaggaattccgcactcccctcttaaaaggagcaagctggagtctttccagagaagttagacctttactttcttcttcaaatgaacatggttctagttttttccccctctcaatttctggcatcatcatgtcctcaaactcccagagagaatccctaaaaggactggcctcaaccatctctctcactttctgctgctggcataaccaggggctgccagtcctacttcctgaacatctccagtgccctctctccctttccagcccctctatatcttaacttgtgcagtggccccatacctgggcccccagcatacccctaacttctcattgtccattcttcttctcgtgtttaactcctttgtcctatccccctgcaaggtcatctctggccccaatcatgcacaggataaagtccaaacagcccagcatggccctctcctaccctccgtcccagtctgtcttaccctctttgcctcacaatgtcctaatctcataccagggggtccatctctctttctggctttgaaggtgccatttcttctgatggaaacaccactggcctcccatttcccacccacagaactctgactctcccttcaagtccaggatcagccattccttcctctgggaagacacaggcagtatggtccctctgtctttcaggctcctgaggttccctgagttacccttatcgtattgttctggacctgtggaagggtctgtcttttctcctagactagatgtcattgagaacagactgactcctattcatctcataaccccctgtgcctcgcacaagttttgtacgcagtacttaccaattagtgtgcttagcatgaacggatgcatggatggacggacacatggataaatgcatggttgatgcatggatggatgggtacgtggatggatgggtacatggtggctgcatggacagatgattactacgtctgtgatcagattcagcgtgacttcatacaagctctgtcaattatccgctcaatgagcacaggttccagggtaggcataagctgtgggtatgaatctgccattcccttggttggtctctgtccgtttgagcctttcaaaatggaggctcttcattgcaaagagatctctgcattgatttggattccagggttggaggattcatgtttcttcatacaagactcttgacccagtgacctgttccagcactggaggaagagctggctgcagcggacttgcccagaggcattatgttagtctgcactgagagacctccctaagaggtcatagcagtttgggttttccaggaagcagacctgaggcagagaacagcaagtgctcctgggatcactctctgtggaaggaggcaggattgggaagagagaggagttggactgtgatgcagtctcaataaaagctcctgctgactccctcgggcacaacttggagatgtcctgggttgaggaaggagaccaggcttccatatacacatgtcaatatgtgcttccctgggaaggagacacggccttgagagaagtgactctcctcagttgatgcagttctgcagagggccatcaattaagggctgacagccagcagcacccccggcagcccggggaataagtccttcagccctgcatggagatctgggtggcatatcagagcaaccactacagtccatgtggcttttcttcctagcacagagtcttgtacacagtacttaccaattggtgtacttagcatgaatggatgcacagatggacggatacagggataaatgcatagttgatgcatggatggaagggtacttggatggtggctgcatggatagatgattactatgtttctcctaatagcatgtctgtacatttcccaaagcctcaccagggtgtgaaatctcatgccccgggagaatgcttccaactgaaaaactcagttatccaacaccacatctctttctgcccagcactctcagatctcagtcccacatgccctcgcctgactcctccaagtacatgcagacaaggccctgcatctcctttggggcatattctctttccttccttgtgagacatggtaaactgggttatgttgagacttagccctagttgtagcctatgagcaggaggggacttgggggcagattccaaggggaacataaggccttggaggagacagatttctgcactatcttcaggcaagcggggcagtggttactttgcagactcagcaggtttaggggaatctcaggatgcaagatgttggggtgcatctacccagatgtccctgtctcatgtgtcatggtctcatcctttcccaaccagggtcctcatcatggcatagcaaggcaggactaagatgaaaatcaaacttctgctactctcctgatgaagcctgggtccgggcctcagctttccctgctctcaagctgtaggagatgagatttcccttcctagttaccaaggaggacctctggctttcacactacactgttttgaggggcaagagggaaataggaaactcactttgttgcccagctggggtggagcagtgcaatcacggctcactgcagcctcaacctcctgggctctagtgatcctcccacctcagccttctaagtagctgggactacaggtgtgtgccaccaaacccagctaatcttttttttgtagagacaagggtcttgctatgtcacccaggctggtcccaaaccccttgccttaagttgtcctccagcctcagtctctcaagccctgggactacaggtgtgagccaccatgcccagccatactatgcatttaattgactaatgagcattcagtccttccttatcttttttcagtgtgtcagctgagctgagcaacagccatccaatttctctgagtttacaggtcaaatgtctgataccttcctagtgcttttccttccaccagaatatcatcccagctttcacacttatactgctgccctacagcagaggccatctgtgcttcacatacctccagggatggggtcctcactgccagccaggaggtaggtggtctgcctccaaagctaccttaacagctgctttctcagactactcctcgcgcccactgtcccagtttggatttctccagaagtggactctgagttggaggttagagggcaggcttcttagatggtgatcttgggtctgcctcgggactctggatatattagttattattcactgttgtaaaatatttgtacataataattccaatccaatagaaatgtatttctctttacgcaaagataaaagaggtgttttgcgttctcagatggctctcttccaagtggcgactgagggacccaggccccttttctcttgtggctagaagctgtctgtgccatgtggccccaggacctccacggtcctctgaatagtgtcagtggcatgagcctagaggtcttatgggccgggcctggaagtggcaccaatcactctgcccacatttcattggctagaatgagctacatggccacacctgtctgcaagagtctggaaaacaacacttagctcctcttccaaaaatgaagaggaaatgggcttggcaaacaaccagccactgtctgtagcattcgagaaggtgaacctttcctctctggtaggaaactagactagcactggatatcttgctcttagctcagatcagccagtgatgctatggtcactgaagtcattccataactcttcagtttaaatcctggctaccttctttgcactccagactttccatagccacgagtcttctcttaagcttcccgctaaagccttccctaccccgcccatcacatgcccaagcagcagaaactacaaatagcatatgtgagacctagcaccaccagcagaggaagaagacataatgaattttggctcaagacccaagcagcatccttatctccaggagaaagctacaatagcttatttcttcacttcttcagtctcttacagtagctatgacagtttcttacaatttttttgagattcaaacactccaaggatcagcagtggacaagttaatgagaaatacaactgttgctgttaaaagtaaagagctgatcacggtgaaatgtgaagaaattattgcatttatctagggtttgtcagtttaagtgcaggaagttaatgttggggaaacaaaaatggcctttgaaccaagtgaataatgcagttgcttcttactgctatgttttatacctattattaaattaaatacacacacgttcaaatgcttccaagataatgcattgaaaataccttttgggaataagtcatacttccattttgagatgccaatttgagtctacatatttaaatccttttcctctgatctgccaatagaaatgaacaaagaaatatagagatttagtaaaaggaaagaatctatctatctacatggtagacaaaaaggatgactgctcccaacaagccagaatcattgtggcatgtctaccagacataatgtaggtggcactacgttcaggaaaatataggcccacccataactagaaataagtgaagggaaaaccccatctagaaagtaggcaggatagattgctggtagaaccagagttcctataccaccccaccaaccaaataagataaaattgacagtgtcagtggctatagataaagatgagatgtgagatgtttggcaaggggtaaatcttatcctcttatgggtgtgggtacaacaggcctagaagaagcacagtgcacagctactgtcagggccctgcctgtgccacctcagcatttattgatttccatgccagcctgactcccaacctctagcacctgcaaagttttccccaagggctctctctgaccaccagcaccagctccatttgtgtgaggcaaagcagaagtatcaaggccctggaagctgggtgtgtaaatacctcagcttcctcacctctgaggtggaatgattttgaggagcatgctgcacactggttcccagagctccctggtgggactgcgttgcagttgtgcatgctggtaacttgcttgattgtgcactttgtattggcggtctttccttctctgtcccacttcctcactcccatgacaaatgtgtcataatatctcctctcaaataaactacttaggccgggcgcggtggctcacgcctgtaatcccagcactttgggaggctgaggcaggcggatcacgaggtcaggagatcgagaccatggtgaaaccccatctctactaaaaatacaaaaaattagctgggcgcggtggtgggcgcttgtagtcccagctacttgggaggctgaggcaggaggatggcgtaaacccgggaggtggagcttgcaatgagccgagattgcgccactgcactccagcctgggcgacagagtgagactccgtctcaaaaataaataaataaatactaaataaataaataaataaactatttacacttaaattttcatgtcaggatctgcttctgggaaaacccaaattaagcagggagctaaccccgaatcttctgaaggtacgggtggtgggccaaatgaagtggagccattgccatagtggggccataggatgggcaatgtagccctttagggatgagggccattgtcttagctaatgtcaaagtaatttgaacataggagacgattcacccaggttaggggcatccctttaaatgcctccactgcacatacacaaacacacacacacacacacaagtaactagacttcatctcttcctttgtggaacatttgaacagagacccttatatttgacagaacacatctcacccttgggcaaacacaaatctctcaaagaataataaaataaagaaaaatcacctactataagaaaatacttgatggtaaaaacaacagcccaattctgcaaagtctctacaaatattttcctgtatatacatttgagaaaactgtagaaaatcttcctaaatacattcagaaagatccaaaaacacattgcaagatgtttagcatcaggggaagctgggtgaagggtgtatggaaactctctatagtatctttgcaccttttctgtaaaactaaaattatttcagaataaaacataaacacaagacaagactaaacaaaacaaagcaaacattgcctctatgaaagaaatgctctgaaatcagaaaacacttttggcaggaaaagcaaatgtgatcatcaaaatatctaaatgagtgaaggccaaacaatggattggatactgtcaaaacccaaaggagtcacttgggaagatcagcatgagtaatttcccctaactcagaggaaaaggatgaaaagatgaaaacaatgagacaagagagaataaatggaaaatggatcctggaggctcaataaacccccatttggaattctagaaggaatgaacgggacagatggaagagaagcaataatggaagaaataacagaaggaaaagtccctcaactgtaagaaatggatcacatcccaaggatggtgagtaagtgctggcagaaaaacctgcagaaagtagtgacatggacaggcaccaaagctcagcccccgggccatgcctgagccccttggcatctgcccaggtgaacatcgcacagaagaaatgcaaaaaaacactgctctgtctgcagttgcaatacaacaaccaaagaaatggaaaagtcttggattcctggcattgctcctggtgaccgcatatttgcataggtcagggacatctgaggagtacccaaaagaatcctacggagcatgtctgcacagctctaggaaatgaacaaagctaaggcagcctttgggagattttcttggaggtgagggtggggatggggggcttaggattaggtcccaatgcaatgtggcctccaacccttccagtttccttacctttcaatgtctgtgttttccctatccccactccatcactctccctattcagactagaaagcttagatgatgactatggactcatcctgttataccgcagtcctactggtctccaggtgatgactttttatgattagtgtctctctcatatttatccgtccctttacatccctagagcctcaacccaagtccaagctcttagattattttaacactatcccatgtggacttcatgcttccagcctctgaaacccagccacctactgtgtaccaagacttggaccaaaccagatgtcacaaactaaaatgcccataggtgatacaaatgagtgaggcaagcaggtttaacaatggggagcagtggggactgtggaaactggagggtgtgactgaaaggaagagccactacttgccccccccagcccattattccccataaaaaccgtgactcagagaagcccatttttaaatgacccagatcttcccattaaaaaaaaaacaaaaccctgaaactcagacttttttctgaaaccttttctcaaagctttaaaaaccgggtttttaaaagttgacaattaattcaatttttaaactctctgagatattcctatcttctttggtctctgacatattcgcaacccctagaacagtgctcaggaaatattcctgaaggctaagtgttgcacagatgcagtaagatgagcaggattttgcatgagtcttcatgaaaaatctagtttagtcttcacacggtggagtaggtatatcattcttgccttagagatgaggaaaatgcactcacagaggggcagaggcttgcccaaaatcacacaggcagtaccagtactgggatttagttcaggtctctctgaccccactacaccactcagaaaaaaagggacccttctctgtcactatcagcctgtaggttcttatacaagccatcctcaacacttccctgtccctcaaaactacttctctgagccttctccaagttccctttgtctggttccctaaatatttccatcactagcccaatctcattatcttcccctgaactatgaagtggcctcttctatatggcctccctgcctccagtgctgcctcttccttcattacggtctccacagttttgccagatatcattctggcagaagggtgatacaagacttacaagactttcaagaggggagatggccacgcttcagagcctactagttgagtttcttccacatctagtctgacccacgtcccaacctcactgtccaccactaattccccaagtttacaccacagccaaccttttcaaacttctttcctacaattccctacaagcactgtgcttttcactcctccttgcctttgaccatgctgttctttcccacaataatgcttgtgcttcccttctcctttgaaggactcttactcacccttaaagacctggcttgaatggacccttgcaagagaacttccctaagacttccagagtcacccacagctttctcatggcctcctagtgccttgtgatgtttccaacaaagcagcacatctcaccttgtgtcacagccactcgatcgcgtatttgcctcctcaaatagatggctccctccttgtcttcttctatatgactgtccttatgcctagcagaggcatagatttcaacagattcaataaatatgttgtaaatgaacaaatagttatagctttgccctttgcactcacgtagagggaggaacaaaatatcgtttataatgatctcatttaattcttttaataaccctacaattctgtaattacatccatcttaccaaggaggaaacggacacccagagagattaatatgctcaagataggacactagtaaaaatttaaatccaggaagaatagctagtggatgctggtcttaatatctaactgataggatgatctgtgcagcaaaccacagaagtatgtggcacacatttacctctgtaacaaacctgcacatcctgcacatgcacccctgaacttaaaataaaagttgaaaaaagaaaagaatttaaatccaagtctgtgaacttccaaaatccccattttgttcatgataccctgtttcccttccatgtcagcaacagtcctttgaattttccctctggaatcttcttgtcatctggctcagcaacctcagttctttcagccattcctgacttgctacagagtcctgaccaacttgagcaggtgaagaagttcaccattcttcatcccgttgatttgattctcacatttgatcaccacagcttctccaggcaaattctgctgattataatgggaatttgaggaaagaatggggatgactccttgcaccccccatctccctcaccaagaagaaacataaaaaatgcacatcctcatgactatctcctttaaaaatgaatgacagggttcgcctattctgtacattttataagatggaattatacaatgtatggtcttttgtgtcttttcagagggtcggggagaggagaatgagaagtgactgctaacaggtacagcgtttctttttggagcaataaaaatgttctgaaattagagtggtgatggttgcacaagcttgtgaatatactgaaagctgccggattgtgcatttttttattacggctacatacacataaaagttaccattttaaccatttctcaccatacagttctgcagcactcagtaccttcacacttctgtacaaccatcaccaccatccatcttcagaactttgtcatcctccctgtgttagtcagggttctccatagaaacagaaccagtaggatgtgcgcatttgcgtatgcagtcacgtgtcacttaacaacaagaacacattctgaaaaatgcattgttaggcaatttcgtccttgtgtaaacatcatagcatgtgcttacacaaacctagatgtcatagcctcctacgcacctatgctatgtatggccgattgctcctgggctacaaacctgcatggcatgtcactgtactgaatactataggcgattgtatgccatggtaagtatttgtatatctaaacatacctaatcctagaacagatacagtaaaaatacagtagaaaagattttttaaaatagcacatctatgtaggacactcaccatgaatggagcctgtaggcctggaaggtactctgggttagccagtgagtgacttgtgagtgaatgagaaggcctaggacattaccatatactactgtagactttataaacactgtaaatttaggctacactaaatttatcagaaatatttttctgagcacagtggtacacacttgtagttcctgcttgtagtttctgattgtaattccattttttgaggaacttccatattgtttttccgaaatgtacatttttttctttttttttttttttgagacagggtttctctcctgttgcccaggctggagtgcagtggtgcctcccaggctcaggcaaacctcctgcctcagcttcccgagtagctgagactacaggcacgcgccaccatgcccagctaacttttgtatttttagtaaagatggggtttcaccatgttggccaggttagtctccaactcctgacctcaagtgatccacccacctcagcctcccaaagtgctgggattacaggcatgagccaccacacccggccccaaattgtacagtttttaaacagtgaattttatggtatgtgggttatatctcaattttaaaagtttaaataatgcagaaggaacaatgtgaaatattctataggacaactagcctggactcttccaaacatcaatgtcttcaaaaatcagaaaaaaaaaaatctaggggaaaagttgcagatcaaaataaagaataaagagacccaacaaccaaccaagaaaacgtagatgacaggaaaggtggtagacactgttggttcattcacccaatacccatttccaacttttctttcttaccttcctccaccgtgaggctggaaggagaaaaggttgaggggactcgattccccagcctctcccacagctcacggtggagagaactcttgcagttctggtcgatgaaatatagtagaaatctactgaacatttctggggaaggttttgctttcctatctcctccttctttctgcctgaaaatgcaatgataaactggaaatggagcaacatcttgcaaccataggtaacaagctctgctacactaagactagaagaatggaaaccccacctgagttcttgatggcatctttgactgccacaccagccacggattccccgcctctggacttcttgttacatgaagttggtgtttgtttgtttgtaattctttaagctattgttagagttcctgttatttgcagtcaagtgcattcccaagtattacagggagacttcctgtaagaagatggcaaattgccttagcctccctatacctcagtttcctcatctctaaaataagaataatcatgaggattagatgaagaaacattttagggttggtgtgaggattcaagttgttactatggttgaagcactcaaatgagagtttatggataagaactcaatacatgttagttgttactttgttactattattactaatactattctcgtagaatgagaaaatgttcacagaactccactctctgaagctcatcaaattaattaaaaaggagccaaggccgggcacggtggctcatgcctgtaatcccagcactttgggaggccgaggcgggcggatcacgaggtcaggagatcgagaccatcctgactaacatggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaatacaaaaaaaaaaaaaatacaaaaattagctgggcatggtggcatgcacctgtagtcccaggtactcgggaggctgaggaaggagaatcactcaaacccaggaggcggtggttgcagtgagctaagatcatgcctctgcactccagcctggtgacagagcaagactgcatctcaaaaaaaaaaaaaaaaaaaaaaaacaggagcccaaaatacagatggagatttcagtgaagaacctagacaacatctatggactcagccacatgctagctcatgggaggtggaccaaaccaaagagagatgcctggaagccatgtagtttgatggacaagagcctgggctctggaatccacttggctgaattcaattcctggatctgccacttattaggttgaaacgttaggtgaatcatttaacctccagatatagtgtggctatttgtcctcccaattttaatgttgtattgtaatccccaatggaggtggggcctggtaggaggtatttgggtcatggaggctatgatggttaatactgagtatcaacttgatcggattaaaggatgcaaagtattgttcctgggtgtgtttgtgagggtattgccaaaggagattaacgtcagaatcggtggactgggagagccagacccaccctcaatctgggtggacaccatctaatcagctgccagtgcagctaaaaaaaagcaggcagaatttggaaggatttgactggctgagtcttctggtcttcatctttctcccgtgctggatgcttcctgccttcaaacatcaaactccaagttcttcagcttttggactcttgaacttgtcacttgaaccagtgacttgccaggggctctcaggccttcagccctgtggctaaaacctacttttgaggttttaggactcggactggcttccttgctcttcagcttacagacggcctatagtgggatttcaccttgtgatggtgtgagtcaatactcattaacaaactccccttcatatatacatcaatcctattagttctgtccctctagagaaccctgactaacactgaggtggatccctcctggcttggtgctattctcagggtagtgagttcttgtgagatctggttgtttaaaagtgtgtggcacctgcccctctattgttcccactcttgccatatgatgtgcctgcttcccctttgccctccaacatgactgtaagctttctgaggcctccccaaaagccgaggagatgccagcatcatgctttcctataaagcctgcagaactgtgagccaattaaacctctcttctatataaattacccaacctcagttatttctttataggaatgcaagaatggcctaacacactccatgagcctttatttcctcagctgtaaaatgaggatgataataatccctaactcaaagagttgtgaagatcaaatgaagtacgtaaggtgcttagcccagagcctcgcccatggtaactgtactagactctccatttcttatatgcttttactgctgctgctgaggttggtgttatctctagagtcttagaaaaggtgtttgataaatacttgctggaatcatggaaggatcaattgaataaatggatggatggatggatggatggatggatggatggatggatggatggttcaatagaaagatggatggatagaacctcttggaagttgggggttaagtaatattgaaatatcctattggtcttggaagggtaacaatatccatacacacatagccccactaggacctgtctggactccctcctccctccccacagcgtagaaaaggtagccttaatccatagtctcagtgtacacagtccctcactgatagtcttttttttttttttttttttttgagatagagtctcgctctgtcaccaggctggagtgcagtggtgctatctccgttcaccacaacctgcacttcctgggttcaagcaattcccctgcctcagcctcccgagcagctgggactacaggtgcacaccaccatgctcggctaattttttgtatttcagtagagacggggtttcaccatgttgcccaggatggtctcaatctcctgacctcatgatctgcccaccccggtctcccaaagtgctgggattacaggcatgagccaccgcacccggccaatagtcacttcttaacaaaactctaaaaacaaaatatatctcgccactgccacaggaattataggctgtcagtagccaagcactggtgcatatctctagactttatttttaataataacatgctgggcttctccatcttggggtaccaggccacctttggatctcctcgacactgtttgacaaagaaagggagtgcctgtaccacccaacctcaagcaagccagccagcttcaaccagacagcaccataaatcataattagcaactacattcaaatgtgggtgtggagggtgagggcagcgaagcccacgccaacctcaggcacaaaggcaaacctcagctcaattcagtgcgaggtaattacagggactgtcagaagctggtgccagctttactttcaagtcgaggaagctgcaggaacctaaaaactccacgtattcaaaaataatcactgaattcccacagtgaattcatgggtcaatcactcaccactcctaaataaagatgtcagcaaagtactttgtttctttcaaatggaacaaaaaaaaaataagttacttccttttcaatgatccccgaaaaggagagagcagagaggatccctttttacagatgaggagaccaaactttagagaagttaaataattttcctagagcaaaagtgagaatgggatctgtatccatgtttgtatgatcccaaagctagcacaagttcccagaagccctcgctggtcatcttagttggtatcatcatagcatcctatggctgctatgtcctgcctgccacagatctgtccagctgcccacagtggtgtccagtcatgtgaacaccttggcccagccaaacagcttctcatgctgagctggcctgggtctgccgcccacatgcctgactcagtgtgctagaggcgagaaagctgcccaagatcacccctctacacatgtatatataactgcccctctaaccttttcccagggtttcgctccagctccctcccaggactgacagcatagctgtagctggacaccttagcctaattcctaccactaaaaacccccagagctgccccagccctgcctgggcctcttgcttatgcccacgtcacctgccttattttctcactaacacagatatttattgagtaccctccctgaatcaggttctcagagtccagcagtaacaagacagccatggccagagcctcatggagctgttagtctagcaaaagagacaaatactaaacaaccagggaccaaatagctccagaatcatctattcaacacatcccatgttctagtgggaagatcctctgtaacaggacatctagcaccaagctaaacatcacccttagttaacactccacgaaggtctatgagttaagtattaatatcatccccactttacggatagagaaactgagtctcagagagccacagtgagcccaggaactcatagtttgacaagtggacgagcaaggtttgtacccaggcagtgtaattccacagcccacactctaaccagctgcccaatagtgtacggcagactcaaggagccaatagcctcccttactttgaaaacaagtttaaaaagtaattcagatggacaccagcatactcacactacccagacattatcttttaaaacagcttgtatttaccactcaacaggtgtccgggtggccctgggcacaaatcagaactcatttcttgccagtggggagacccgttgcaaggatagaggacaagccctccttgcagccattggcaggccccatccatctggccagccagtgttcataggagaggccagctgatacccccatagtcacagccaaggccggccactgcaagctcggagcagcacgactgatttcggatctctctccctggaactcgggaacacatcaattacccatgcacatgctgcccattcggaggacagatattacctcctgcactcaccgcagagccacgcgtcctcatccaagcacagatggaggacaagggcgtggggttaattgatcaagcaacaccagtgcccgtgcaagggttggcagaaaatggctcatttcacagatgcacaggctccttccttgccagtctcctgtgattaaaccaggtcactaacgtgcttctgaacaaacatgcctgaacttacacgttcaggttcatcttgtctcctctaaagtggtcaccttggaatactccacatgcctttctccactctgcaaacatttgttgaataccaaccagacacaaagtatggtgctagcatggtagggtgggatacagttcagtgcaacgtagtcgatttcaaccgacgagcacaaactaggtactaagaccccatagtagatgattagaaggtgggtcctatcctcagtacacaaaaggcaaacaaaaggttattgatcaggcggtgggatatgaggaaagcaggaagttggggaggacagggtgtaggtcatggagacaataccagatagagggtgctaaatactggaaaaatgatagcgggtgtcaattttatgccttaatctcagaaaggcaagacatgtcacaataattgcatttgctataaacctatcccaagtctcagcttactgacctggcaggaaattcatatttggggttcccttcttgccccacaggatcctgtgaaggtctcaagggtcttacacatacacccagctttgggtatgtccaatgagtgtaggtccacactgttgcctttgttagagctgttgtccaagccctctcggcatcctgttggctgataccaatgttgcctccgtgaggttgggctcagatgtgcagtcaatgcccagaccggaagccccaatgcctggggtccaacccccttaaaaccccttaatagtcatctgctctggtttcctgctgtttccagaaattcccttctcctcaaaaccaaactgcaagtttggtcttcatgatctcgctctctccctctctctttctctctctgtttgattctactttctccccatcaatggtctttccctccctccctccccactttgcattaccccctccccgacacacacacataaacatccacactctggcactaagcctaggttttgagataaacaaaaccagggaagagatccctattcaggcaacttgtgcttttaatcttacaacacaagcctccctcagcaaggaaagacaaaaacctcttcaccttagaatatggaatgcaagaacacaacacaaattcatgtattaagtcatcccatctgtcaaaggaagccccagaaacagaaatatttagaaaagaaaattttacttgcagagtgcaagggaaccagacttcagaagcactggttcaccaaatgcaaacacagcaattatttccaagaaaacaattgcaaaattatcaagttcaccaggtgtatattaatcgtggcatgaaaacagcaactctctcctgtgacggtcataatcacaaggtcctgatctgtcttcagagatcatcatagcaagaatcagagataaaattgtctttctcagggagtccaggtttaagggaaacatacaaggatttgtgatttgggagactctgatatgttaggtttgtcttggggtttaggaatgtctatttttatcatttcactgtctttttcccctaatatactgtgtgagatgcttaattatactggaatcagaacaaagggatagccttggtttctaaccatcaggtgatctacagggaaaatgcaatggaaatccaaactagttaatcagagaaagtcataaaagtatcagtatgagacctgaaagcctgagcaggctttgagcacatgatggagagaaggcaaagacacggggcctgttcaccgagctgggaggctcacagtggagcctgggggatgtgaggggaggtggaaagagctggttgaaggtgaggctgaggctcaggagtgggtttctctgaaatcccagctgtctggagcatgccaagaacagcaatctgtaccagtggccttggaatcctaaaatattagccagacaccaaggccatttaatccaacctctcttccaacatagatggggaaactgaggtcagggagctagggtgtgtccccacaatcagtgatagatagcatgtttagccttcaggctgatggggaggtagggaagtgaatttttgaaaatagttaaaaagacattcagagtcaggtgtgaagaatcaggcaagaatcaaggtgtgcgatgccacttcctgttaaaatttttgtaaaatcaatttttgtaaggataaagacaagaatgagagcaattttcttatgccattaactgccactgaaggccattcccagtggacagtccaaacaccgaagagactgattggaatatggacacaacccccaaaagtggccaatactcattttggtggttacgctctggggtctttactttcttcctgtgtattgcttatgttaattaaaaataataatccaaggccaggcgcggtggctcacgcctgtaatcccagcactttgggaggccaaggcgggaggatcacaaggtcaggagatcgagaccatcctggctaacacagtgaaaccccgtctctgctaaaaatacacaaaattagccaggcacagtggcaggcacctgtagtcccagctactcgggaggctgaggcaggagaatggcgtgaaccagggaggcggagcttgcagtgagccaagattgcgccactgcagtctggcctgggtgaaagagcgagactccgtctcaaaaaaaaaaacaacaacaaaaaaaaaaaaaacataaaaataatcatccatgctcactgtgaaacatctacacaataaagaaggaaacagagtaaagactgaagggtccctttaatagctatccctgatctcactcttctaacaacaaataacgttagcaattgagtgtctacctttccagctgtttgcacttattcatcaatctgtatgcatataaacgtatttaataaagggtttttctacccaaagggtattatacaatatattcttcatctttgccttttgttttcacttagcttgacatcgcaaacatcttttcatgtcacatagcttgaccttattctttgaaacagctgcaaattatattgtgtggatgttccataattgatgtgactgttccttatgaatgcacatttaggttattttcaagtttattattaatataaatggtaccacaatgaacatatatatatatttgtacatatatgaaaatatccttaaaaaaacagatttctggaagtgaaatgctgattcagtgaatatgtgtattttataatcttgacatcagcaccgtgtgtgagagagattcattttgtgccccttcccaaaacaagatattaatgacctctttaaaatgtttgtggaagactattacatttcaatttatatgtccttgattatgagtaaggctttttacttgaatctgtagttgtggtcaattcagctcctccgagaagcagatgccaagatggaattatacaaacaagagctttactggggagaaatgcctctggaaggcaaagagagagagaacaggaggatgccaggagagctccagatcaagaagcaggtctgacgtttgtgcaaggaagagggaagagacaggattgagtaggtaaatcctcagaccagagcacagttctgagaaagccttgacaagaccactgtggaattcccacaaggtcctgcttccccacgaggggaaaacctaggggaggcacagcctggcgtgaccctcacagtggatccaaagatgctctagcttgaggccatcagtcagctcttcccccacaggagtttcttttgaagagaggtctgggcagtgcacctccatggccaccactggaatccagggtttcctctagaagttacatgaccacacctttgcttacttttttactccatctttgttatagatctgcagaaacccttcatagattcggtgggttcatgccttggttttttgttgctgtttcgtttttgttttgtttgtttggttgtttattttttgagacagagtcttgctcttgtcacccaagctggagtgcaatggcgcgatctcaacctcactgcaatgctcaccgcaacttctgcctcccgggttcaagcaattctcctgcctcaggctcccaagtagctgggattacaggcacccgccaccgtgctcagctaattttttgtattttcagtagagacagggtttcaccatgttggccaggctggtctcaaactcctgatctcaggtgatccacctacctcgtcctcccaaagtgctgagattacaggcgtgagctgccgcacccagcccactccttgttataggtgctgcaagtattttgtccccatttttgctttcttttatctttggttgcatgtttcactatataggagttttttaacactttaatttttttcctctagcaaaatcttttatttttttttttcctttaaggcttttgtgtcttatttaggaatgctgtcttctttaaatagaaagaaaaaatgggaggcgggtcccattactttatcttatacattccctagctgcacagtacactactgatataaatttagtataaatgattattttatgcaccaaccaggccttgattcagtttgcttctcatcattttcagttttttgctatctaattattagaaaatgtttccttttgaaatgagtggctgggctctatttattcaagtcaaaacccatgatttctcccacaatgtcatcaatgagtttgtacagaagaaaaaatatctttgtgacagaggatgtgggaaagatctggcttttgagaaaagcctatgatgttgctttcccagtgggctgggcctggagacgtatgagacctcagccagtagcaaggtgtggatgggaggaagaggagccctgaggagccggtgatcagagcacccacttccaaccccagaaagctgaagagcctgtcccaaggatggtggtccattctgcacacacctgagtcatctctattgcagcctccatttggttttctccatagcagctctcataagctctaactgttacaatcatggcttggaagcaggagtttcctggcacttcagggctcactcttaggcaagtagacatgggatgtctgctaatcacttgtcaacatggagagaaaaggcccaccctgcaggggacaggccagccacagccaagcaggcccttctactgccccacactttccttattctaccttaccctccaagatgcttactgtcagctccttccaggagctgcctcacagggacagcccagcatgtcccaggatgccctctgccacgcccacccaccgcttaccttctcctaaaccccctcccaagaccacagcaattagccccagacaaatatcattgatctggcactgccttcactcccatttttatgtcaggatgaatttggattctgaagttgatctccttgttgtgcaggttttatgagggaaagattaaatcatcctctgatgtgtgcttcattaggctccaaatccttgaagagtcattaaagcaccttctcattgaaatgctctcaatctcagcttgatgggtatcagcaggaaggatctctccattatttgggacctaaactggctgggaagctgggccagacctgaccctgtcacaacccaatgagcctggcccttctgtagtttgtggcccccaaaatctaccagtgcaacatcaccagaggctggctttgggctggctttcccagaaaagccattcctgcctgtcctctgtggggacaggttgccctgagtcatccacattctcaccaccacccacagctgcaagtctaatctgtgagctgggtagggctcatccatggtcaaggctcagtgtggggccaaggtcagggttcattctggaactaggatcagaatgcagagtgggaccaggatcagagatcgatctgagaccaggattagggctcagtctgggccagggtcaaggcccagtctgggatgagggtcagagctgttattaccagaaccaaggccaacacagtctacatccaggattacacatctatctgtggccaggatcagggcctcgattatggcctagtttatggcccaacctttggccaaaggctcattgacccaaccccagcctggcatcaaccctacatcaacttaggatatcaggacttgacaccttatctaagcacccccagtctcaaatattagcatacccattcccaaccaggtggtactaacagccactgagaggctcaagctatttcaggtgacagaaaacagacaggagtatctgcaagtgagggcctgtattagaaatgggtgggggggatgctggggcagaattggaagggtctagaaggcagcagaagtcaggagtcagggcatcatcaggacctcaacctcagaaacccaagacacagacaaaggagactgcattatttccaacccttcctggcaaaatttaccacatattcatctttctgatttcagcagcagaaagagccagaatctatgagaagggatctgagccaatgccaagtttccttcccatcactgcagaaggcgggaggacagtgaggttgttctcctggacttgctgggtgacctctgacaggttgttctccctctctggacttcagggtattcacctacaaatggaggagttggagtgactcatctgccatgtcccctcagcttggccaaccgcaaagagaatgagaagagagtagcagccagaaggaagggtgttgaagaaggtcgcaggcgagagagagaggatggcaggcccaaaggcctagattaagcccagtgtgactggacacaaagcgaggggacagacgagaggggagggcagaagataggaagtgactaagcccacagggcctggacacaatggaagtcatctggtttttatcctgtgggcaatgaagaaccttgaaggatgctaaacaggtgaggacactgccatatctgcattgtagaaggatctgtctgactgctgcctgcaggacggataagagaggacaggatggctgtgagattcactgggtgggaagattagaacaggattggtggcagaagatgatggtgaattctgatctggacccgtggagttcagatgactgtgggatgtgggactaccaagtgagggtgtccaggaatgaattgacaacatgaaccaggagtttgcatgagccaactgggcctaggttatagatgagggagtcttcagtcattgccaaggataaagtagagggagagaagagaggggaacctggaatggacatgagacacccaacatgtcagcggccaacagaggaagggaagtcagcaagggagcccgagaagggaatcactggagagatgcaggaaaacaaacttcaagaggtggtctacagaaaattagagcaatagcaatattgaatgtggtcaagagcctgagggcatgagaactcaagtcattcaatgactgtggagcccattgctgactttagagagagcagtttctgagacccttcttggggcagcagccaaactgaaatgagtaggagaaggggttgaggaagtgggagtggagataggaagtgtaggcaactgttgagaaaagttctctgtgagtgggatacagtgggatcatagatgggaaggtgtgggatttggggcagagggtgttctaagcagagagactttggggtgtcctaagcagagagagactcggacgtgtgcaaatgctgtgggggaggacccaggagagaagaaattaaaaatacaggaaagagagctattcggggaaggagtgggtcattgagtgtccgtcacttaccatcacacaaagcactttccatatgcctttaatatttaattctcccaacctgtctgtggtttcacagagctgtgctcacttccttcacagcactctgtaaatgattttaattattctttggcttgtttattgactccctttcccactaatcactaagctccacacagggacttcccagtctccatcacctctgtcttatcttgctttgtttcatcatgacacttacactccctgacactgtattatttgttactcgctttttgtctgtctctcctttcccccacaaaaaatgtaaactccagggcagataggacaaagtctgccttgctctctactgtgctcccaagcctaccactgtgcccagctcatagtaggcacacaataaatatctgtgggaagaaagagagaaagagggagagaaaagaaggagtatgagaggagagaatagagggaaagagtgagggaggggaaaaaagtaggagagaaagagaaaaaggaaggaagaagggagagagggaaggagaggcagagaaggaagaaaggagagaaaggaaaggagaccgggcacagtggctcatgcctgtaatcccagcactttgggaggctgaggcaggcagatcagttcaggtcaggagttctagaccagcctggccaaaatggtgaaaccccgtctctactaaaaatacaaaaaaattagccaggtgtggtggtgggttcctgtaattccagctacttgggaggctgaggtatgagaatcgcttgaacccgggaggcggaagttgcagtgagctgagatcccaccactgtactccagcctgggcaacagagcaagattccatctcaaaaaaaaaaggaaaaagtaaggaaagaaggaaggagagagatagggggagaaggaggaaagaaagagagagagagaggagggaaggaaggaacggaaagagagaattctctaagaagaggttctgaaaaccacaacatgctgtccaagtgaaggacaagaagaacccagcgcatgccaagctcgcagcacctgccacaggcatagcttcagctaagcttcatgacaactttcggaggtaggaactactgttcttttttcagaaatgaagaaattgggctccatagaggttttaaggcctgtcagaaatcacacagctggtatgtggtagtgccagagttgaaagccaacgataatggttttgtttttgtctgcttttcctaaaaccccgagctgaattcctgcaccacaagcctctggggatgatcattagtccctccctccacttctcctcaggaccacaggccaaggacaggggctgacagagttcatcgggtgttctagaaccatcccccggctgctgtcctgcagaaggaaggggagacattggtggcagaagggaggagagttttccccagagagctggtggctgggacttagcagaaggacagttgagaaagagatttgagagagaagattgacaggtcccgtggcatgggatgtggggtgggaaagagcgagaggcacgtgaggggctcgcaggtttcaggctggggaaagggcagttgcgctgctgacagctgagacacagaaaatagaaagggtgcatgtgggaagggaggtggcttccatgttggacatgctgagcaagtggggttggtgggacacccatatggtagtgtccaacagcaagctctggggagcagtcccagctggggagagaggcctgggacagtcagtgcagccctggatcgatcgtaggggtgctcttgctgagggcagcatgctgagcatggggctgtatcagccccgtgggccccaggagagaaaagcagtcagaggagcaagcagtgggtgtccctctcagctatgcggggcagaagcaaaagacaagatgaatgagctgctctgtgtgtttgcatgacagaatattttgcagcctccctggataaacaagctgtcatccaccacccaaccctctgtcaactgaagcagcttggggaaaagataatgctgcgggtttggactctctcctaggctgccagtgccctaattactacacaagcaaaacaagcccacagagttgtaggcagagaggggcttgctggccgactagggaggagtgtcactttcccagtcccagggaggggtggaagacaagcactaatgtttattgagcacctactgtgtgccagacacttggcacatgtcatcttatttaatacagttcaagtatcatccccattttgcagatgaggaaacagaggctcagagaggcctgataatgcactcagttaaaggactcactccaaggtcttcccattgcacttcactgcctccctggaaaatgtccaggtttggtttcctctcttctttcccaatcctgcagaatcaaatccaaaggcgtgttcatgactttgcagctctattgactctttttgtttctttctaagacgtctatttgtaagaaataaaattgttgggctcagcagcaggacaataactataaagaaatctgccattagcagcacagactttagctcccagcattactgtatattcaaagtagattcccaaaacatcatttgacacaaacagtcattccaaaaggactccatttgcctccttcctcctgccccgcctcaggcacgcctgaccaaggtcgaatgaagaagaggaaaggaggtgagagaagactccaagcagccaggggcagctgagaaggaactaggctgccctgctaggagatggcagcagtcccctgattcaggggacagataagctgattcttcccaccccatccccttcctgacctgatagatggggaaactgagtttcagagaggagcagcgactggccagtgatgggattagatcccaaaccctttgactcccagcccacagtgatcttccaacacaacatgcagcttcgtcagaggccaagaaatccatttataaggaaattttgtatgtgcatttcatttgtatgatttaatttttttacctcaaaaagaattataatatatagctttcaatgcaaatgggaaaagcttacacatcttcatataaagagaaggaatatccaaaaagtaacaagaatgttcctagtgctgtctttcatagtaaatttgcatgattgtacaccacactccagccacaatgatctttttcttagttcctcaaagcccccagccttgttcctacctgaggaccttttcatttgatattccctctgcccagaactcatttccctaggcttacatggctggatttctcttgtcactgagatctcaactcaaatgtcaccccctctcaacagtcttccctgaccaccctccttcaggtaaccatgctgtcaatccccataacaatgggtgtcaaccctgggcacggtcacttccacctgcatggcttaaaatacagattgctgagctccgtcccccacagtttctaatttaataggcctggggtgagtcctgagaatttacatttctaacatgatccaagattgtgctgatgatattggtccaggaatcactttgagagccaccgccctacaacatcaccctgttttattgtcttcgtggtgtttatcacaatctgaaattatcttaggcatctattcagtttctttattatggcttgccttttttactgattaggagctcctgagagaagggtgactgtctgtcttgtttattgcagtatctccaggactcagaagagaaccaggtatatgataaatgctaaatgagtatttgtttaatgaataaattagtgagtgggtgaatgggcggatggtggagggttggaagaagagggagggagaaagagaaatgaatggatgcatgggtgatgaatggtggatacatagggaatggatggctgtgggtgggcgggtgggtgggtggatgaatgaatggatggatggaaagatgagtgggggggtggatggatggatagatggatggatggacgaacagatggatggatggatggatggatggatggatggacggatggatggacagacggatggatggctggatggacggatggatggatggataaaggggtgggtgtgtggatgggtggatgggtggacggtgtgggtgggtggatggatgaatggatggatgaatgtataattatctcattctctggattcccacctctgtatatgtcatctttgttccactccaaattgatctacaggtaaaaccaatctcatttttgatttccaaaatttcaactgatagaagcaagaccatgaaacattttgccgaggatcttgaggggccatggccaggagacacatatgacaaaatagcaaatgacataaaactgcacacaggcataccgctcttaaatgccctttcagctaccccatcacctgcaagtggtccccagctttctgccatcttgaagtctcctctctcctcctcctctgcttcatcttcctccttttcctgttctttgtcaccttctcaaagatctaaaaataataatcttttgcattttcccatgtagagcagctaaaccatgattttttattgcttgagattcccaaaaagaccagtgcactccctctgtcttcaaaaattcctgcatctttgagactcaggcaagtcataccttcctcctccatcttttttgtagcctcctggaagctatcccttattcagtgaagtctcctggaagctatctcttattcaatgaagtcttcagtcccagctgaatgacttcatcgttagtgactgcagaagacaggtcaactgctgatagccaggtgagaagaggaggtaagaggtctaataagagtgagaaaagctttaaataattgctgtgaatggtaaaggaatgagctggctggagaaacacaagcccagctctagaaactacagttggagttggtaatgagtaagtcaaagaataaagaatccaagatgtgaagagttatccaaatgctttcttctctattctcttagtcactttgttagcttccaattgcttctgtaacaaattaccacgaatcagtggctaacaaggaaacaaatgtattatcttacacttctggaggtcagaagtccaaagtgagtcagcatggctgtgttccttctagggagagcatctgcttccttgctgtttccagtttctggaggctgcctacattccttgggtcacagccccttcctccatcgttagagccagcagtgtagcatcttcaaaacacacacactttctctctttttctctctctctccttctctctctcactcactcactctcccccaccccctactccactccctgatctctacagagcaatatatttgcaggtttcagggttggaacatggcatcttttggagagtggggcacattattctaccagtcaccaactgagacagtcacttcccacatttcaacatcatctggaaccacttcctctaaagtcattaatccatgcatcccaccatggttatggggtttaaacaagtatcgtatttaagagagaaacctttagactagctgcattaggcttaaccttgagcaagtcattctacttcctgaacctcagtttcctaacccagaagatgagctttaaaactaatagaacaactagcagtgttttatttgctatgtgccaagcattgtctgagtggcttgcatatgtcatctaacttaaatctccctagagccctatgagtacaaatgaggaaactgagtcccaggctggttatataactgcctgaggttgaggttggtgatgagcaagtcaaggaataaagaatccaagatgtccctgcaacctcctctccttccagcctgcatgcccaagcaacccattgcagccattcttcaatcttatcaggacctccagactatccacctttcctcttgctcccatccacaagccctgcctctcttcctttcctccctttctcatttggatcctgtgatctatcattactaaaatgcctcacccctccatatctccatcacacctattggcaataacccaatcttggatgggcttccatcttcctcctccatgctgtcactggggaaacactgctggacaaaaccacacaacagtacatgtaaatcttcagtgtccatcacaactttaccatggaggcatgggaagactgagaagccaatggagggtgttaagcttggaagtgactccatcagaattgtggaaaggtcacctctgcaacaggatggagaacagattggaggaaggaggcagggagatgaaggagtgaccccttcaccccagcacctcaccttattctccatgctcggtggttgttcacacttagcattgtattagtccgttttcacgctgctgataaagacatacccgagactgggtaatttataacaaaaaaaaaaaaaaaagaggtttaatggacccacagtttcatgtggcttgggagacctcacaatcatggcggaaggtaaaaggcacgtcttacgtggtggcagggaagagagaatgagaacccaggaaaggagtttttcctcataaacccatcagatctcgtgagacttattcactaccacaagaaaagtatggaagaaactgcccccatgattcaatcatctcccaccaggtccctcccacaacatgtgggaatcctgggagctacaattcaagatgatatttgggtagagacacaaccaaaccacatcaagcatcctcctcctttcctcttctctaatattcctgcagttcctcatatcactggtatacatgtcttcttccttggctagacaggcaagacgcttaaacaaaggatctaagttcaagtttaatcttttcactgacaagttctgttaacatagacatttacttcatctctctgagcttcaatatcctcatatacttttgacactcaacagaaaaaaatactgaatgacttaaacctgtgatcaatagtgctacaacattcataaaaagtgccttgcaaaccatacagcaccctgtgattattacctactatcattatccctagtttgtagttgctttgaaagcagggttcaaaacttacttgtgtttgcctccatcccacccttgaggaataaggaaaccactgggtgtcacactaatgaacatttaaagaaagtgtaaaacaacaccaaggctgcccttttaaagccttctctttccccttcccaaggtgatctatgctctggtttgatttttctctgctctgaacgatccactctaacccatgttcagaaattagtctgtttacacggaggtgcctgcctcctgatggcaagctcaaaagaccaaacagtgaagcattagaaggccctggtaaacatgaagatcttgagaattcgattttgatttattgaacaggataatccagtgccattttgttcagagagtttggttaacactgctcttctgaggttgttatcccaaattccctggagatcccagaagtgaggcctcttctcagagccatctggtcacccatgtttctacaactacagatggtccctgaatgatgatggttcgacttacaatttttttactttaccatggtgtgaaagcaatgtgcattcagtagaaactgtactttaactacccgtacaaccatgctgtttttcacgttcagtacagtattcaataaatatgtgagatattcaacactttattataaaatgggttttctgttagatgatattgcccaaatgtcagctaacgtaagtgttctcagcacgtttgaagtaagctaggctaagctgagatgttcggtaagttatgcattttaaatgcatttttgacttacactattttcaacttacaatgggtttgttgagaagtaagcccatcataagtgaaggaacatctgtacctccttttcccattaggggcagaagcaattactacccagatcactctcgcacatccaggcacaaaattgccttggaattacttttcaattttaagagaccctggagcacctagcccaggagctgtcactctctgcaattaaggggaaaaaaaaaaaaaagaaaaccttaaatgatgcactgtttgccctgttgggggaagaaagaagcaaatagggcttaatcaatccccacctcaggattagacctcagcagctttgaggcttggacctactgagtgattctaggtctggaaaatttacctctgagtctcccaggcttgcagcatcacttgggagggcactgcagctgtttttccccagttagttgccagagtgtccaaaacagtcatggaggggtggggaaggtgttgcaactggaggggtggcaaggtgttgcataacgactcccaagagagtggcaaaggccatcttttctcatcctaggcatcctaggagcctgtgcatctagttctgtggcagtattctgtgccatctcatgctctgtgtaactggcttcccttcctgaaatttaaatctggagcaaagggacaaggaaaccacaaaaatattggggggaaggagggtctatcccatcccacactgttcctgcttcctaccgttagaagctgcctcaattcggacacctcgttttccagcccctgcccatttggaaggctctgacagcatccattttgtaagagttcactagaattggtttctgaaccttttaatctggtccttggggaaagcagaaccatattctctgaattctcctctgtgtttccctatgtgttgatgaaataaacatccagcaaagaggttgacttcttggacacatttgccccagatgatatgggactgaactacttaactacttcccctttccctctgcagcacatacgcaccaatgtaccaggtggagaataactactctctgtcccaggcccccaggggcaggacagaaattgctgatatagctgcaacctcagtgatcttgcctgccttatgaatttcactcctactatcaattgtttaaatagtgagcaagaaaaatgactctcgaagtaaaacaatttggcaaaagcaactcatggtctttagctatctccgaagaagcagagtcaacccctgcaccactgagatgcatcacagtaggggttcccggaggacgcaaaatgcaactcttatctacaatttgggacccttatttctgcctgaagttctttctattcatctcaaggagcatcacaacattcatgtaactgtgattaatcaagtatatgtggaagtaaatctacccagctccccagctctgtgtttctcttgccctgagagagagcctaccatcttcctcaatgaactcagagtatagtccatcatccaacagacagccttccactaaggatacccaggggttcccaaggcattctgtacaacacttctctctagtggtcagagtaggctaactgatatgatagacaacacccaaagtctcagtggcataacacaaggaagtttgtttctcatatcacagtacaacacaggtcggttggggaagtggacatttctactccatacagtcattcagggacccaagccctttccatcttgtggttccaccctcccctaaatacttgaagttctctccattttgacatcagatgatgaaagagatagaatgttgagaattgcatgggtgatttttatggtccacattgggaattggtctaattgcttctgcccacatttcacaggtcagaactcagtcacacaatctcatctcattgcaaacaagtctgggaaatgtagtctagctgcatgcccatgaggaaaaggaatggggcttggtaaataaaggaatgccactgacccctagcagtgtgtggtggtggtggtgtcgggtcctgtctcctctgggatgtgagctcttcaaaagcagaaattgattttatttttgactctctgactgatgaacaccagtctatgaacccaggctgaacggtccagaaggtatcatctcagaggtggagctgaagtcacagctgaccacactgcccaactagctgccaggcacctggcacacacaggcagattttgacaaaggccatcagctgggagcctgacaaccacagcagacccagagagtttcaggcacagaggcagggagaacctagaagaaccctaagccaagaaaatagctttctcccagagcacagagatttctgggaagggcaccaacccagcttggacttagggtttataaaggactgcctcactcatcaatgtgttaattctcatcacaaaagagatcaggccttaacatacctactttacagatgtgggaatagaggagctttccccaagtctaacagcactagaaccgaagtctcctagctaaggaactgcatgaacctaccagactattctctatgctgatcacccatgagcattcaaggaaacatcccttagggacctttgggaacctgagaagcccatacctcctctggaagtattccgtgctgtctctcgctctgtgtaaccaggtgaccacgtacgcctggcaatgagttacatcacccagatgtgttttgaggaatctgtttgttttcaaaattgacttaaataaggaatgtttaaacatgtttcttgtttttaatgcaggtccttattttaagtcatgtttaaaaatcaaaaaatttcacataaaaatataaagctgtgggcttttcttttaaaaaaaaaaaaatctcaggaggcccagctaccctgagtctgattcccacaaggcgacgctcacccagagctgagtaggcgctgttcccagagacaagatatgtgtcctccaggtccccacaacccccaccttcctatttttctttttggtccatgttattcatttaaatcactctctggcctttctgagcatttgagtttgtaatccctgtcctatttatgctcaagtccttgatcatttatcccctcaatcattcatctatacactcaacagttgtttgctgagtggttgttctgggccaggtttgtgctggacagcaatgatgaaaataagacatgaccctgccctcagagagctcacagtctaaagagaaacacaaatgaagaaacacatccttgtaaatgtattaagcgctgtgaaactcatatttttaaaagttcgtacagataccattggtgcctgacccacatcgcctgggcactcaacattcccgcgcaaggagatagtttcctactatgagcacctgccactctcccctgagtgtctcctgcatgcaggctagaagcattggagagtgaatgtccccagaaacagctctcaaccaatgactaaccagagttggtggataaataccccagctcacccctcaaggaggaaaatcatgatgtgtgttttatgatgtccaccagaagttccccagttgccaatatcggtaagcttctcggtaaagtactctatactttcccttccccatcccacttcccctctctcctactgtccctctctccaataacctccccagtcaaccacttgcattcccacccttgtcttaaggtctgcttgtagggatgcccaatctgagacacgcaccagtaaccacctgggaagcgcaactcttttaagttcgtttaactgaaatggaaatgtactgccaattagcctggaatgggtcagggaagaaatctaaacaattcactagctttcctttaaaaagtaatcataacaataatcaggctaatgaatgctgcctgagcaatggcagggactatgtgctttagcacctggggctgctgattgccgtctctttggggacttgctgcacattaaatcagattaatcagcccctttgcagagaggccaggcccacagccatgatgaccttcctttcaatgaactcctgtgatgctgcttttagaaagaaggcaggcctgaaaaaatcatggagtagatcagaactcaggaaaaactgatgttatttcatcagttcctctcaacatgccttggagggagacaatatcagcttcactctcaggggatgggggtggcaacagggacttggaagagtcaggtgatttatctgagttcacatggtccaaatccaccagactctacgcccacacaactgccctgtcaccaggctgtatgtgtctgtgttttcctgtgtctgaagactgggatgaggagggaaggaaagagcactaagacctaaccttgggtcttagagcaggggccacagtgctgggaatggccattagcctgtaggttgctgtttccctctggtccagaaggtgaccagagaagaacaaaggcaaagtaggcagtgacacagcaggaagagaatctggagcagaagaaacaaagaggatacctttttcttttgtgggaagatcatgagcaagggttcaaggcagctcagaaatgtctgggggtgctttatgagggattaactctttaaagaaactgatgaggccaggtgcagtggctcacacctgtaatcccagcactttgggaggctgaggtgggcagatcacttgaggttaggagttcgagaccaccctggccaacatggccaaacgctgtctctactaaaaatacaaaaattagcggggcatggcggggtatgcctgtaatcccagccactccggaggctgaggcacaagaatcgcttaaacccgtgaggtggaggttgcagtgagccaagattacaccactgcactccaacctggggtataatagcaaaactccgtctcaaaaagaaacaaagaaaagaaaaggaaagaaagaaggaaagaaggaaggaaagaaaaagagaaagaaagaaagaaagaaagaaagaaagaaagaaagaaagaaagaaagaaagaaaagaaagaaagaaagaaagaaaaagaaagaaagaaagaaagaaagaaaaaatgaaactgatgaaagttcatgtgctaacatttggatatacatagaaaatgaaatatctttgggtaataatctcattatgttgtcacaggcagatgaggccaaaaatatagggttctgctttcttgagcgtatgtaaagactaggcagcaacgtacataaagggccagcaccaggcctggtacttcagtttggctccatgaaagtttgttcactccttctcacccctttcccaattctagcaaattggaagctccccagcctgatttttcagtgctaatgtctgccttccagaatcccagactgcctgcttctatcaagaagccatagcaatatttccaacccatcaacacttaaatatgaggccaatttgcccaatacactgtctatttattttccaggctacaatctttatgatgcatattcctgaggcagttaatttgctcttgaatacatctctttgtgtattggttacccatttcattagctgtgatattgagactggctgggacatgtaggggatttttcacagagtgaaagaaggtttttaataagccccatcattgctggctttatggtgccatttgatgagcaacaaatgtattcatttggcagctgcattccttaatcaggtattcactgagtaacagcatatataaatatggaaaaacacagaatttaaggagctgagtgcaatcattttccacagggattggagcattgtctgtattcatcatcagttttcaggcaagggcctctccttgctgtatatgggattctctacagcatgcagtacccagatatgactcactaccatctatcaggagcacctcttctccacctgagatgctgtcctctcttccacatcaaacaagtccccagcatcttgacttctttggccaatggtactaaacctttcctgtggctcccatctcttttgcccttaaaatgtcccccagaaaaaaattactaaaccaggttagctcttaaacataaaatgtatcctaatgattagagcaagaaatacactttcagtttcttaatttctcaaattattaaaaattaaaaatacacaactctttcaaagtttgctgactcagtctccaacttatgttcagtcacacttaagaagtaagacaccgctgcctggagtggctcacacctgtaatcccagcactttgggaggccgaggcagggagatcatttgaggccaggggtttgagatcagcctggacaacacgatgaaaccccgtctctactaaaagcacaagaattagccaggcatggtggcaaacacctgtaatcccagctacttgggaaactgaggcatgagaatcacttgaacccaggaggcggaggttgcagtgagccgagatcatgccactacactccagcctgggagacagaatgagactgtctcaaaaaaaaaaaaaagaaagaaagaaagaaaggagtcgctttaataaatagtcaaattagtgtcactacttgcatttaagtggcttccaaatttagatataatgtttaaaatgtcaaaaagattttatcacaaagtaccttatggttgcaaatggtacaatgattcaccagttatggaacagagttgagcagatcaggaaatcagtcttccgcttgggttcaacaattgccttgtcatttaaggagattcataaaccaagtgaaaaggaaatggattagaaaaccacatttttctggttttaaaatgaataagcaaatctatttctttttcttctctgaaacttactagaaacatggaaaagggggaacaatagcagatatttcattcttgttaaattaggaagcacattaacttatttgttttgtaaaaagagagctgtagttataaatagtactaacagtaatgtaataatagcccccaaaccccatcctcagcatatggaagttggtcaaacacagtcaacaattggaccagggaagaaaagacacctgctgatgaagggcaggtgagccccaaacttggggattagcttgagaagatccttggctttacccagtaaagaattcaagggtgagctggtgatgtttacagcaaccttttattgaacagtactgctccctatagaggagggctaactctaggcagtgctcccagagttggcaatgtatgggctctttacaactgtatttatactcacttattcctactttcagttatacgcaaattgaggggtgggttatttagaactttctaggaaagggcagtaacttctgagtcactgccatggaaaggggtggtaactactaagttgttgccatggcatttgtaaactgtgatgatcctgtcgcatactaatgagcaacggtggtggccagggattgccctcctcatcatctgctggtttctgccagtttcttcactttatcctgtccaaagcagatcctgttttggtcagcagggttatgaccagaaaagaagtccagccagtctcctacttcactgccacagccaatctcaggcagatctagcagaacacagcactctccaaaatgggatgcacaccttgggggaaaaccagtgacctcctgtttgaactagtaagattgcaatgagcagaatgtctttgaagagtttcctaaagcccgatcaacaccaggaaagggcagaacaagcaggtctgaataaggaaataagcagacaatttcacaagaaccaggagaaagaaattctaggtaataaacaatcctatcatttctgaagggaagtaaaagctaagactcacacatacacacacacacacacacacacacacacacacacgtatgttccaacatccaaccctatctcatttgggattacactgtgggccagaaagagatctttctagcctgcctcatggcatacctctgactcctgctccatacagcttttccacaaatagcttctaatctaaactgctctcagtaattatcacaacggaaattgcaacaatatatgaaaacactgagagaaacaagagggaaaggaatatacaataataagttgaagaatgcatactaaaaaatgtgtaacaccaagcagataaaaatagtaaccaaatagtttcctgtggactcagggaacatagagaaaaaaggtatctccatgaatcaagaacttaaagcagaaagacaagagctcatggaaaaagtaataagactacaggcagagatgaaaaaataactccagagctttggaagatgaaaaaacaattgcagaaattaaagttgttttgggagaaagaaaagaaagagatatactgaaaacacagtcagtgaattgccaaccttgagaaaattgagcaaaatgaaaagtaaataaagaatttaaagatatcagagataaaatgatggatatggaagagagacaaaggagattcaacaaagacataattggtgtccctgaaaaagataaaatagaatttaaaatttttcaaagatactatttaagaaaacttttctgaatgacaaaaagcttaaatctatagcttagaagaacatactatgtcccaggaagaaaataaaacagatgaatctatactgaggcataaattaataaggttactggactaaaaatttttaggaaaaaagtttcaatagacatacagaaaagaaatttttttaaataccaagtaatctgtaggttcaaaacatttagtttagcctctgacttttccataacaatgtttaaaactagaacacagtaggcaatatctacaaagtcttcaggaaaagaaaagctgatcaaagatttataacctagcaaaatgtcagttaaatttaaagatagctagtattgtttaacatgcaagggaataccattcccattagcacttcttgaagaaattaccagaggagaattttaaattttccaagagttgaatgaaaaagttatgttaatagaacttatggtgagccctgaaaatgcttaagtgtagaacaaaggctaaagaaccatggagagatacagaacaaaacagaaatgctatagggcataacagcataaaaatgataatataataaaagtcaggagggaaagagggaaagaaggcaggtataagcacactgaatacctagtttttcttaatggggacggcagggctcacaatatattgttcaaagctaataaatcaattaattgaagaataattgtattaaaagttctaagagaattaataataaaaatattattgataggccgggtgcggtggctcacgcctgtaatcccagcactttgggaggctgaggcgggcagatcacgaggtcagaagatcgagaccatcctggccaacatggtgaaaactcatctctactaaaaatacaaaaattagctgggcatggtggcgcatgcctatagtcccagctactcaggaggctgaggcaggagaatcacttgaacccgggaggtggaggctgcagtgagccaagatcgcaccactgtactccagcctgggcaacagagcaagactctgtctcaaaaaatatatatatgatcgattaaaaataaagtgttatagatgaaggaagagaggtgacagaaggtacataataagtgttcaataaaggttatgctgtttcttcattgttcacactggggtgtaaatacataccatctaggacagagatactagtttccctccaatattcattatctcctccttttaagtagtagaatcccaactttcccagaaaaaggactgcatttcccaggctcccttgcaactgggaatggtcatgtgaccaagttctggccaacgagatatgagccaactaaatgtgtgcatcatctgggaaagcccttctcttcctctttttccactgatatgtagtgaggccacttggatcacccagatgaaaacaatatcctgaagacggcagagcaccaagatagaaagaattgccctaccactttgactttcacataagagcaaaatcactgtcttatatagcagcagtccccaacctttttggcaccagggactggtttcatgggaaaaaatgtttccatggatgcagggttgggggtattgttttggggagattcaagcacattacatgtattgtgcactttctttttttcttttcttttttttttttttttgagacagtctcgcactgtcacccaggctgcagtgcagtggcacaatcttagctcactgcaacctccgtctcccaagttcaaagattctcatgcctcagccacccaggtagctgggattataggcacacaccaccacgcctggagaatttttttatttttagtagagatgcggtgggtttcaccatgtcggccagggtggtctggaactcctggcctcaagagatccatcaacctcagcctccctaaatgctggaattacaggcataagccaccatgtccaggcaatttctatgattattacactgtaatatataatgatataattacataagtcaccataatgtagaatcagtgggagcctggagcttgttttcctgcaactagacagtcccatctgggggtgacgggagacagtgacagatcatcaggcattagattctcataaggagcatacaacctagatctctcacatgcgcagttcacaatagggctcacgctcctatgagaacctaatgctgccactgatctgacaggaggtggagctcaggtggtaatgtgagcaatggagagtggctgtaaatacagaggaagcctcgcatgctcacctactgctcacctcctgctgtgcagcccagttcctaacaggctatgggtaccctgggggtccagggttgagaccctgtattacatgagacatatattttgagtctccatcacatgccaatgaacctacagtataacttaactaaattccgtcttaaaaagaataatgcattacatacttaaaatcaaatattatttagccataaaaaaatgaaattctgatacgtgcatggatgaatctttaaaacattatgctaagtaaaataagtcagatgcaaaaggacaaacattgtatgattcctttcatatgaggcagctagaataggcaaatttggagacaggaagtagaatggtggttgccaggctggtgggagggggagctattgtttaatgggtacagagtttccatttaagatgatgaaaagattctggaaataatggcgatggttaaacaacattgtaaatatacttaatgccactgaattgtactcttaaaaatagttaacatgataaattttatgtcatgtatattttaccacaataaaaaagtcagagaaaaaataaaacaggaaagaatagtcaggaaaattctttttaaggaaagtcacagggaaaaacagctatgctatctaatacggtctcaaggatcctgcccctgtggcgctgccctgtcccatacagaacctctagtcattatgtggctatttacatttaaatttaaatcaattaaaattaaatgaaatttaaagttcagtttcataatcacactgtcctcatttcaagtgctcaatagtcacactggacagcagatatagaacatttccatcattacataaagttctgtcaaacggcacttgtctagagcaatctccttcctgaattttagactcatacatccaactgtccatctgtgtgccttacaggcactccaaaacaaattcaagaacttctccatcaattcctacccccaaaattcctttctccttctttggcattttctctgtatgtaaagagtatcatctggccaggcgcgagcctgtaatcccagcactttgggaggccgaggcaggcagatcacctgaagtcaggagttcgagacaagcctggccaacatggtgaaaccccgtctctactaaaaatattaaaaaattagccaggcgtggtggtgcgttcctgtaatcccagctacttgggaggctgaagcaggagaactgcttgaacccagagggtggagattgcagtgagctgagattgcaccactgcactccaacctgggcaacaaagtgagactccatctctcaaaaaaaaaaaaaaagtatcatcttcatgctggttgttcagatcagaatcttttacatgacccctctctttcccccaacgtctagtcaactactaaatcttactaattctaaaatctgtctgtggttctgtggcctcttctctgccttcactgtcacctgggtgtccacacagtctcctaactggtcctccacgtcctttcttgccttttgcaaacagcctcttctgcacacagaagccagggaaagatttcaaaaacaccgatcagattgtgtcagttgtgctaaaaatccttcatgggcttcctgttgaccttaagacaaagtccaaaatcttctctttccacagccctgcatgctctgcctctgccgcccacttccctgcccaccaccccatcccctttacaggcagtaccctagccacagtgagggcagcaaagttcctcctccaggaacactcttccacactctatcccccatcgcctggctaactcctactccaggtcaccacccccaaacagcttccatagtaagtaaggaggggggtactttaaggcaccaaagatgtaattgaacccctaaaaactccagtcaggcctgcgatgtgtccctcctctactcactgctgagcaaacagtgaaatccgttagaccgaccacaaacgaggttgaaggccagggtgtgtgtgtgtgtgtgtgtgtgtgtgtgtgtgtgtgtgtgcagggcttccactgatagagaaagtgtaacccacccagctagactgtcagggcaggaatcatgcctgcttgctgctgtatccccggttcctagagccatgcctggaacacctggatcctcagtgcacgttaaagaaaggattagtcaatcaagggccttgttctctgcccacttacttctaagctgtaagtgaaaattctcagatgcaccagcagaccaggagatctccccgacttctcaggcccacagtgatctttctgagacaatatcgccactctccaagccccaaggggagaagatgggcaaagaaaggagaatggcgaggataaaacagcagatggaggaaccctattccagctgctggcagcaatgaacaaggaaaaccaatctcagtttggaaaggggaacgtttgtagggacttggccaggattataatgaaaggaggaaattcttcaaatgttatgaaaataacacaatatttttctcatatctggaactgcctgaacctttcttacgatagtcacaacatcaaaacaagccctggatctataagaggcaggataggatctctaatctgtagagagctgggaggcccaaggccatggccaaagggacacaatgaactcaggtgtcaatggtcttatccagaaggcagtgtacgtgggccagagcccaggtaacaggagataagatggcaggtgagtagcagctctgggagtctaggtatgtggtccttgctcaaaggagtagatgggtaggaatcaggagatacccatgcagagtgacagaccaatagccaacagcccatctcctccaaggagacctccctgacgtcctctgcatagtaaagatggaggtacttttaggcacaaaagctgcaactgaacccctaaaaattccagtctagggcccctggactggtgaaaagtgacacttctctgataaatttttgcagctctcagggaattagctggcagtgcttgagggcagccagagagctggtaggagagctggtagcaagtgtccctccccagactcccacatcccctacagttagctctacagtggccctcccagccatctcaaacaccgagagcttctaattggcaggaaccacatctcataggatgcacaaagtggaatggaaagggaagtgtctgccattcaggtaggttgtttggggaggaaaaaagtgactctgcgatcaaaagagagagcctggagtcttgctactcaaagatttgctatttcatagaccagaagcatcagcatcacctggagccacgttacaaaggcagcatctcaggctccacccagaccttctgcatcagagtctacatgttaacaagctccccaggtgatttgcatgttcattataatttgagaagcaacaggctagagagctgaacttaggtctttgggactccaaactcatacatctttgaacacccgcatttccatggtgctttgaaaatcatacagcatgctggcatgttttctctttatgcttccccagcctgaatagacttgagcaagggaggaagacaaacaggaaaagaatattgtgaaagaaactagaactcattaatagagtgcctactccaagccaatcacaatgctggaagctgtcccgtgcattctcttatgaagtcatgaaagcaagtgctgaagtcaggagaataataggcaccattttccagatggagagaggctgagaatggttgagtaactttaccaagttggtgcaattaggtcttgtttagctgcgagaaacagagacctcatgctaactcaagcaaaaaggtggtgttgtaaagaaaatagattacccagaatcctaggataggaaacacaagaagaccaaatcctaggagcctgaaagtggacagcacctgtctgtttcttgccctgagatggggattcttctgcaagtaatttactcatggaggctctcaggaggaagggagagagggaaacaggacaaggaaagggaaagaagccaagcaaggatgtcatacggggtggagaacaacttcgccctgatgccacagggagctcaagtacaaatggaaccacagagttggtcccctcttgagataaggaggctggtctttagtgccccatgtcagccagtcactggcggcagcttgctgggggaggggaacccaccaacctggcctgaatgccattaggccaaggatttctatggacaagggacaactataaggcattagtggtcaacactctcagcagcctgagggatggcgcacctgcccagtgaaaaggaggtgcactggcagtgcacgcgtgtgcatgcatgtgcatgtgtgcgtgtgtgtatgtacatgtgtgtacatgtgtgtatgtgtatgcttgtgtgtgcatgtatgtgcattgtgtgtgtgcatgtatgtgcattgtgtgtgtgcatatgcaggtgtgtgtgtgtgtacatgtgtgctcatgtgtgcgtgtgcatgtgtgtacacgtgtgtacctctgtgtgcatgtgcatgtgtgcgtgtgtttctctctcccagggacaacctctactctagcatgaggcatctctgtatctccttgtgcctggctccattctcacctgtgaaggcagttctccttcccccacactgtcctcttctgccttctaactcgtttgcacacgtcttaaaacaaccagtccagcccaccaaggcctcttgaccaaaaggtttcaactccgcaacctcattgtttaagcctcttagccaaattcctgagcgagaaatccaattagccacaccagtcacaggtcccagtcaacagacagaggcaccctgaagtcacatgtccactccagccatcagctgaggactcaaactacataatgaaacacaaccaagagaactggggaataagcctgttctttgaaagcttcaagtgaaacaggctgtgatagaaatttctagttctgctcattggctggaatgcaaactaacatttctctggcaccagagttgtgttcctccctcattacttcccctttttagtgtaattgttcagaacaaaactgtcttggttcaaatcccagctctaccactagctgctcataaaacctcagacaagttatttaacttctctatgcctcagtttcctcatctgggaggtaacattaatacctgcctcgtagggttgttaggaggattaaatgagttagtatttgtaaagcacttagaataatgcctagtgcatagtaagcataacagaagtcactgctaaataaatggatacaataaatgcatttttccagctctcagcaggaaggcagagatgaacggggtagcccttggaatggaagctgaccagcactccagaaactattgacacattgagctgtctgggatggagccctgggagacagacagcaatgttaccagtgtggcgtgggcaagaaagatggtgctgttccctttccaggaactcagctccatggcaacttgagctggctggggcagcatggatgtcaaagctcatgagaatccctgggaataatagcgaccaatatttctagcattctgctgtagataatataggtgctttttatgggttgaattgtgtacccaccccccccccgcaaaatttcctactcagaggtttgctatttcgtggaccagcagcagcagcataacctggagctgatgttgaagatgtaccccctcagaatgtgactatatttggagacagggtctttgcaggggtaatcaagttaaaatgaggccattagggtgggccctaaccccgtatgactggtgccatttttaaaaaagggaaatttagatacagagacacataaaaggaaaatgggccaggcgagatggcccacacctataatcccagcactttgggaggctgaggtgggcagatcatctggggtcaggagttccagaccagccttgccaacatggtgaaaccccatctctactaaaattacaaaaattagccgggtgtggcggcacgtgcctgtaatcccagctactcaggaggctgaggcaggagaatcacttgaacctgggaggcagaagttgcagtgagccgagattgtaccactgcactccagcctgggtgacacagccagactccgtctcaaaaaaaaaaacagaggaaaatggtgtaaacgctgggaaaagatggtcatctacaagccgagaagacaggcttaggcagatcttcccaacatggctctcagaagaaaccaactctgccgatatcttgatctcagacttctagcatctggtaccgagaaaacaagtttctgttgtttaagccaccagtttgtggtacttcgttatgcagccccagcaaattaatacagtgccttagtctgcaccaggcaccatgctgttcacttcacaggccttagctcaattatcctccctcccatcctgtgaggtagaagttgtgctgtcccacttcacagaaaactcaagcacagagccagtaagtactgtctacaatcacacagttaggaaaatgcagttctagaccctgggccatcatcgaactgaacgatgccttgcacacaggaagtactcatgtggcatgcgggaagccctcacctgacaagcgggaagccctcaccggacacatgggaaacactgacctcgcacgtgggaaacactcacctcgcacgtgggaagccctcacctggtcatgctgctgccactcctctgttctacctccctcttgagaccaaaggcctcactaacaaccagtccatcaaagctttgagaaggagtcaaactgccccactctggggaatatcaggtaagaaaccaggccccagggagaagcagggcttgcccaaaccctcactgtctcaggctctaagaagcagaaggacctagaattgttgtaggagttattaggaaattattttaggcagatagagaggaaaaggagtccttgggaagttttcattttttaaagcatctctggaaaagtttcttgcaaagccccagctcttagagccaggccggcaacctctgatatgcaaatatagaccattagaaaccgggtccacccaacatggcgactccagccaccttcttgcccttgccccacgtattcctggcaacatggctgcccccacatatccccacatgtgtagaacatcatggtgccccgcatttgcatcttaagaggctagggtgggagggccagctttttctctggctacgtgaatgacatgcctagtcaaaccaatcccctgagccttatgcaaatcagacaccacctcctccagattctgcatatatacctggctggtatctgtggcaggcgggtacctccttttttgtctttggaccccccaccaccaccccccgcctctgtacagggaagcctcttcctgctgccatctcttctctttcttgcgcattaaattctctgctacttaaaacctctccacgggtgtccgtgtcattttatctaaaccggcgtgaggaccaagaaccctggtgttcttcactgatcggagccgtatcacaatcatggcctctttgagtacttcctatttcctggctcctgcactgtcctccagcgcccattctttgttgaatagcccttctttccccaacttggagcaaaagcctctccttcctgagagaaccggagacctactcttaattatccccttgaactggcagccacgtctgaggcttttcttcatagtggaaaactgccttgcatcaaactaaaataaactcacagcccccactgggctttcacatctgagccacagaccggacaatgttattattttgcatgagaaccaaaagatccaccaacaaaagaggcctagcagaggaacatccgagaagaaagagagacggctgcaagcacacaagaggcactgctttctctcctaaattacttctttttaatgtacaaatggtgaggattttcttattactgggggaaaaatgttaatttgtaaaaaacagggaatttttttcaccataaaagcaagaagaaattggaatcatccacaagcccaactctcaaagataaccactgtttataaagaaaaggaattctatttatgagtgcacacagacatgtaaaactggtcctgttttttctactaagtatgttgtaaaaatgtttctgtgctgaatcaaagactgctatttgtgctcatttgcggtttagtaacagaatccatcaaaaggttttatgattgtccacaattcttttaaaaaaccctacttcccagctgccttttccatctagaggtagccatgcgaccaagttctagccagtggaagggatgggagtactgcactgaaggcaatgaagggatatgccctccattgcccacttttgctactttcagctaaagggagtgaagacaaagtgtggactgtcttggatcatgttctataagataatagaagaagactgataacaacatagatagactgataacagaatagactgataatgagacagagggctgatatgacaaaatagactgttaacaagatagaaggcagaggaacaaaatataaagagactggggccctgagtgacctcatggagcagagctactgcaagccctggactgaccatctccaaactgtgaatgaggaagaaactcccattttctttgcttcattataaattgggtcttcttaacagtagctgactctatattctaatacatgtctccaggtctacctctacaatatagtttgaatgacttcgtatttttcatcatatagatgttcaatatcaaaatgtattgaattcaactaagtataaattgttggtcatttctattgcttttaaacttttcataataaataccactgcaatgaatatcctcatacataaaccttgggtgtattactgattatttcttaggatatatttatcgaactagaactgctgggtcaaacaatgcaaacttaaaaaatactttttttttcaagagtattatgtttattgtaggagggtagcttgcttgaacttccacctgaacatccttgtatacaaatttttatttgcataggcttgcaagatttgccccatatttgaattcatttttattatgccctctctcctgtatgtatgggaagaaatataattagtcatgtttcctaggttcatgtgtgtgtagccttagggatattacttaacctctctccattcagcttacttgtttttaaaataggggttctaaaactacccacctcatgaagctatgagaaatacatgagttaatatgggtaaagcttttagcacccaccatatagaaagtgctcaccaaacactagctattattatttttattttctagaattatttatgacagttgctttccatttaacaatatatttagatttattccagttcaaactatttcaactcttactgctcaccattgaaatactgaatttcccattcttaaggtgtttgtttcaaatcctgatatattgaaatgcattttcctgtgcatttttcaggaaaaaaaaatacaagtggtatagtccctgtcttggcatatctgagagtttttgttgttgttgttgttgttgttgttttttgagacggagtctagatctgtcgtcaggctggagttcagtggcgtgatctcggctcactgcaaccacctcctgccaggttcaagcaattctcctgcctcagcctcccgagtagctgagattacaggcacacaccaccaagcccagctaatttttgtatttttagtagagacatggtttcaccatgttggccaggatggtcttggtctcctggcctcgtgatctgcccaccttggcctcccaaagtgctgggattacagacatgagccaccgcatccggccgagaatgttttcaaattgtcttccaataccaatgacctgctgcttggccatagaatttttgaataacattttccttcaaagctttgatgtcctattttcttctgtattcaatgttgcagagaaatttgctgttaacgcagttggatctttcttcctttattttttaaatgtttactttcatatatacttgtaggattatttcttcagccttgaaatgcaaaattttcccaggtggtgaggaggggatggtttctttatgttaaattcatgggaaggctttccatctgtaggttcaagtctttctttagctcagttaagctttctgcaactgcaccgttagatgctgcttctgctgcagctgccaccactgctagtattgctgctggaacaatgttctaggttttgagtctgtgtagcttccccttcatctccttcatcttccctctcattactttcagatcctcatgttctgggagagcttctcagatatcgagtctcgttgacttcttctcttaaacagttcttaaatctgtctacctctctccatcccagctactgccaccccaagagatcttcctgcttctattctcatacctctacaattcattctctgcacagcaagagggggaaaggcatctcttttaaaatgtaaactgtgtcattcttctttcatgttgtatcattcttcagtgggtttttttgttgcatttagaataaaatcgagtcacataacggcctccaaaacactgcatggttcagccttgtgggtccaaagcgatgtttatcagcctttcccactcaggcctgttagagttggtagcattgtaggatgggtgcagagcttggagtggtaggaaaagtctaagaaggtggagattctcttatggaatacactccacacacagctatcaggacaaggataaaaagagatgaagatgcaggaaatgaggcttggtatggaggaataagtcgtcactgttttgaagggccagcaggttccaggtcctaaaagtatttctggatcagactaagaaggtaataaagagtgtatttattgaacatctgctatgaacaaacattgctctacattagcccatttaatcttcacaactttactaattatctccatttttaataaagaaagggatactctgagaaggtgaataacttgcccaagatcccatggctaacaaggagtggagacaaagataaaatgcaggtctgcatgatttcaaaatttctaatctttcccctgtaacttgtgtcctccctaaaatgtgagctgcaacgtggcagctggtgacagagccatgtgaaagtggaaggcttgaataggtcttttagagaaaaaccaacttcttgcactgtttcagagaccttcagcctggtcagagtaggctagataataaatagatcccaaaatgcagcaatccaagcagatattcctggctggaggacaactttttccatgttccctcctatggatccaccagccttgtcatcagaggtagcctcctagaagaaggaggctggtcatcatctgctcttcaaatgcaagaagatctgctgaatgacttcaagatctttagagatggtacagttgctactttgggaggccgaggcaggtggatcatgaggccaagatattgagactatcctggccaacatggtgaaaccccatctctactaaaaatacaaaaagtagctggatgtggtggcatatgcctgtagtcccagctactcgggaggctgaggcaggagaatcacttgaacccgggatgcggaggttgcagtgagccgagattgtgccactgcgctccagcctggcgacagagcaagactcaagtctcaaaaagaaattgcaaggagcctgagtcccagcatggtaggtcatccatcaaatgcccaattgcattatgcttgagcaagaaacaaaacttttactcttgaaaagccactgagatgttggagttgtttgttacagcaaccagcatgagttacaccaaataatacaaataatatcacaggttaaaaaaactaaggctccaaaaggcaaggtgcatattatgtcattctcatgttaagttcagggctccttccccagggacaccctgtcctagtgacctgcagctagtcctggttcaggcttcagctctctatggaactcagggaaattcacttcccctttgggcctcagtttttgcatttgcaagataagggctttgccttagttggtggcaaggggcactctgaagccatctgactactgcccacagcccaaatgcatcattccatagtaacatgtgcagtcaccacacccgttgggtcattgagtcattccttgtaagaagagggtcaaaacttttttccccaaaagagtcattccagcttattatagaatcatctacatttagaatgcctttacagtaaccatggaaacaatagcatgtgtgaggaacaaactttattctaaatctgctgatgaggatgaagaaatggctccttgtgtggacctcagcaggcccagcatggttctgctctctcctctgttggggctcgacttggctgctggccataagcagctaaggccaggaagaaaaagactttcctgggggagatgaccaatatctagactaaattttgcaagatgaaccaaggccttcagtaaacctccagtgatctggaagaataaattgtatttcttttctgcctggcccccattggcccagtacaacctgaaggcagaggacagaatggctgtttgacacaatccatggtaatcacctccaggacacagagaagggaaggggagagtacagcatagatatagagggacaaacagaaggtgcccagcacaccttcagagcactcgtccccccttgtaacttagagggggggtctctaagtccatgtgattatttaaagcctgtgtttcccattcaaccctgacctctattaagagcatgaactgggctcattcctaacagctagcatagcacctgcacatagaaggtacctataaatatttactgagtagtgaatgaaaaaataaatggctacatgactgagcaaactcctcagtatgaagaacacacacacactaactcctctagggaagaccccaggatcactcaggaccctttcttctcaaacccagaaagctgaggaacagctatcactgagcatcaaacatcaccctctattcctttgtcactcagcctggaactcagccctgccccaggcaggggctgagctggttcatgcttccctagcatactacacttctcccactgactcagagctggtccccactacccatactgccagactcagtatagcaagggacctccagcactgctgtccaccaactcctctggcaagtcctgcccacctgccacgtctgacccctgcatgtgaataccagcctaattgacctgaggtcactgtgccccctctgatagtgtggttaagacgatggactacccactgctcaatcctatgccgaattacaccacactccaccaggccacacctagcccagtctcactctctttcccatgtggctactgctgaagtcccagaattccaaatgtcaatttcagcatagcatccaatcagtcaagtagctagggaaagccaggaggggaatcaagatctgtaggctttgctcttggggcaagttcaaaccaataaggtctggctttgccttcctgactcctcctacatggaaaaggataccaagtctgctatgtatagttgtaaaagttgttcactgcacaaaggtgcccagttaaattgaacagtgagggttcaaatccagcctgtgttctacttgccaagctatgtatcctggcctgggctgggtcttcccaacagaaaggatgtcttctttccacttgcactaaggtgccatataggctagggagccaccttgaaacaaatcctactggaaatctgggcaaaaaagttcatgtttaacaggactggggcctggaatagtctctttatatctctgattttcaggaaggctgatggcttcgaggccagtccttcctgtagaaattcattacacaagaaaagaccttctagagtaacaaaagatattgcaattacatttatcaaagaaagcatggcaatcaatgtcttatgcacagaccatgtttcaaatgcccttaatcaatggctgtgctaattacacatttattgcaattaatttcatttcaattctactttaatcattaaccttgagtgagattgggcagatcagagagtttgtgtcaccacagggccaggacccagggataagttgccgtccttcgattgaaagatgccgctccattaaaagttggtttattggctcaaggcctttttgcagggggagggagttagtttctccagggaggcaattcataatgtgagtctgaaattgaacacaggaaggcaggcagctgtgcttacgaattaactagagctgatgtttaatttgcttcttattgatgccatttcctcactggttcattagctgtagttggagaataaatgccttcacagttcattctttatgatgtcctcagcttctgggtcagcctcatttgttccttatcttccctccaaaagagggctctctcttagcctctcctcatgtctaaaggctcatctgtgaatttctggggcagggccttggcttcagtctctgcacagagcagggtccccttggtatctacagtgtctgcccactgagactaccaaggataatgccattgcaacagtccagataggggtgttggaaaataacttgccctgtggcaaagcagaaacaacttgtaggataatagaactcgggctttggaatccctcagaccagggttcaagtccaagttctgatacttcttagctctgtggtcctggtgtagtaggacgagccacagacaaaacccctcagacaccgagttaaagaaggaagggctttattcggccgggagcatcggcaagacacacgtctcaaagactcagctccccaagtgagcaattcctgtcccttttaagggctcacaactctaagggggtccatgtgagagggtcgtgatcgattgagcaagcagcgggtacgtgactgggggctgcatgcactcgtaattagaatggaacagaacaggacagggattttcacagtgcttttctgtacaatgtctgtaatctttaacataactgattcggtcaggggtcgatctttaactaccaggcccagggtgtggcgccgggctgtctgcctgtggatttcatttctgccttttagtttttacttctttctttgggggcagaaattgggcataagacaatatgaggggtggtctcctcccttactgggaagacaggttaatctcctgagtcaggtaagtgtaagacaaccatgcccagcacttggaaggaactcaaaaagttcaactgccttatgcaataaacccttctctagggtttacagcaaccacaccttagcaagattttttactcccaggagggaagacctttctacaaaacatttctttcactagcccaggaggaaggaaatgtagagattttctggtctagaccttcatcttaaagttggggaaggaagggaaagcttgaggtcacattgggagttggtaccagaactggactatagccaagtctcctagttctcaattctagagctttcctaccacatcacaagctagcctctttgaacagtgatttgtcagtatctggtaaagattgaaaatatacaaatatcccatgtatgtgctcatggagaaaagaataaaaatatttactgcagcatcatccatcatcaaaaataagtactaacttaaatagccctccatagagaaacacagagacctggagactaagaaaccagtccttgaagtcaagctgactctgcttttagcctcctaaattaaaagatagatagaataggtcttgtttgcaaaataaattcaagatctactcatctatcaatagcaaaaaaaaaaaaaaaagagagagagagaaatgcagaggcaaattgtgatgtgttcataagttggaatactatacagccattaaaatggatatacctgatctatattatcagcatggattaatttctaaagcataatgtttgattttaaaaagcaagttgcagaatatttatagcatgataccacgttaattttttaaattcacaaattcaaagagattataaatatatccatatgtaatttagatattaaagcataggcaggaagaatataccaacctgaagggagtggccacctggaagaatgggagaatgggatcaggagaagcataaagaggacttcagcaataagggtagcatttgacttatcttttgagaaagatttgacacatattggattaaatgtgctcatctgttcatattgggtggcaagtccttggtctttttgctttccaaacttctctttctgcttgaaatttttatcacccatgaaaaataaaatggttaagctttgatgtagattctctgtctaaaaaaaaatcccgatgattatcacttacggagaacagagactctgaaattggagatggttccaagataacactcaacagcatgagagataggatgattacatgtcccagtttgccagacctaaaacagagcttgttgcatgtagtactcaacaaatatttattgaatgaattaaagaattgaaatataatggataccaataaatgcattttctctcctttcctcatgaaatcttcacaggaaaatcagttaaatggggcagagtgagtcatggaaatcaatgagaagccctttgtctaatcctagactcttggagaaagatgatgatggctgggacaagagtgatggtagtagacatggagagaaagaagcagacaggtttcaaagacaataggtaggatttgctgatggaatggatatggggattaaggaggaagatcacagctaagattctggcttcactattcccttggagaagagtaaggaagagggagagattctgagtttcatcttgaacatgctgtatttaaggtataacccaactttcaaaggggaacacactcccttcagtgccccatccaataccaagaacatctctccctgggttctgtgtattggctcagccctatgccagggccatgtgtgtctgcttgatgccccaaagggctcctagcttctattccttgggttctcaggaagtttcctgtgactcagatgttaattggccacagtcaggtggactttgaagcagcaggtctgccagagcccagcaaggcagaactttcccttttaccttcacattgtcaaactcctgataagaagctgtattagtccatggtggctgtattagtgcattcttgcactgctacaaagaaatgcctgagtctgagcaatttttaaagaggtttaattgactcacattccacaggctgtacagaaagcacgatgctggcatctgctgagcttctcaggaggcctcagaaaatgcacaatcatggcagaaggtgaacggaaagcaggcacttcttatgtggctggagcaggaccaagagagaagggggaggtgccacacacttttaaatgaccagctctcacaagaactcactatcacaagaacagtgccaaaggggaaatccacttctatgatccaatcacctcccaccaggctccacctccaacactggggattacaattcgacatgagattgggtggggacacagatccaaactgtatcagtggcacacccctgtagtcccagctacttgggaggctgaggtgagaagattgcttgagcccgggagtttgaggctgcagtgagttatgattgtgccactgcactccagcctaggtgacagaacaagaccccatctttaaaaaaaaaaaaaaaaaaaaaagccgggcgcgatggttcatgcctgtaatcccagcactttgggaggctaagacaggtggatcacgaggtcaggagatggagacaatcctggctaacacggtgaaaccccgtctcaactaaaaatacaaaaaaaaactagccaagcatggtggcatgtgcctgtaatcccagctactcaggaggctgaggcaggaggatcacttgaacccgggaggcggagtttgcagtgagccaagatcacaccattgcactccagcctgggtgacagagtgagactccgtctcaaaaaaaaaaaacttctagtaagagtgtttctaaaccgcaccagaaggcttttatccctactgggtctgaccccaaaggggacgcattccaagagcctgttgcctgtgagttacatagaaatatgaaaggattcccggcccctgccctctcagggaacactccactctgacagcactggcatgcacccaacagtcaatgtctgccttcatatccctaaaagagaacagagaggaaaacccttctgtaagtggaaggttttacagtgccagtgaaaattattcaaaaagtaattaacataatcaaaatctttgtaggtcatgctgaaaatgccttttcttcaaacatcagtcttgttcttgggtctcatccattttttttctgtcctgaatagtgtggaaagttggctttctccagatggactcgctgacttttggtggctgcaaatggatttcccaaaggctgtgcacagttggttttctttcagcttttcttaactttcatttatttttcttccatcctcaccctggcattaggccagtgctttcgggttgaataaatttaaaatgccatttttgataattggaaaagccaagcccacctttgggccgtatcacataatgtaaatttttcagatgaagggattataggtcatcaatctctccgctaatacttatccataaatccatcagacaccagcgtatcaagtcctggttcaagttttgtgcaactccagggtgcttccaattatctcaatgactctttcaaacttcttgaaaatttctcaaaacaaatcaaattttcattcagtgtccaattaaacataagtatatgtcattcaagactttgaaacacggtttcttaacctggggtacacaggtctatggatagaattcagtgatctatgaacttgagcaggaaaagaagttacctctttttttcactaatggtctgaaatttagcattttcttgcattatgaatgtagacaacaaaccatagtagcagtagcagaatctggggctttcaccaataaaatccatggatattttcatatcacctaacagttgctacataaatcagatatttttaaatatctacatttaacactactttgaaatcacagtaattattaaactttctgctagcttgctatttaaagtgctaacaaaaagcacatttattacaatatcacaaattttcttaacatttggataactttatttcagtataattgatttcctttggaattctatgtctttttatacatttaaagactctttacagagcagaagttcagaggcctcaccaaactgatgactgcttgggggcttatgcagaagaaaaaggctaggagccctgctttggagggggagaaataggggaaggagggaagaaattcaataatcagagatggagagcctgaaatatgtaattctgttctgaacttcttaaggggaggaggcatctgagaaggaagcattaatgttatatagtaaagaacttggccattcccaattagaggtctgacctttgttccaggctcctggggggtaacctctaaacccttgaaatgtcctaaatgattggacggtgttattcgtggtggcccctctgaccacaccttgcttatgctaacaaggtgactcatggtgggcctctctagggagtaggtgttgaggattgagttcactcttgtgggccatcaaccagtcatgcatatataatgaagctccaataaaaactctggacaccagagtgtccaaagggcaggtgagcttcccaggttggcacggtacaccatccacactgtcacatctcaatgctgagaaactagcacatcctgagggcaatgaaagctatgcatttggagccctttcagactccatcctatgcatctcttcctttggctgattttaatgtatccgtttcctgcaataaaccatatccatgattataatggctttcagtgaggtgagtccttctagagaattattgaaatcttagggtggttttaggaagcctcccgaacttgcagttggtgtcagaagtgaggttggtcttaggaggactctttcctctaacttcgtagttggaccctacctccttgcagttggggtcagaagtcttgggcagacttggcagttgggagatccatgctctcctacctttcagtttggctgaaaggggtaaatgtacatgggaatcacctgaggatcccattagttatgattcagtatgcgtagggtatggcttgagacactgcagttctaacaagcaacaggttgttgcggatgccactgtctctggaccacgccttgaatagcgagctgctaaagcacaaccaatgacatctcttctcagcttgagatcctcagtgggcatcagtgaccaccagagacagtacacacctctgagtatggcattccaggtccttcaggatccagcccctgcattctcttgcagtgtcttcaacccccttggccctagctctgtctccagtggtccacctggaatccaagacctccatactcacatgtcttgtccatccagtctgcttctggccacagccccatctctttatgagcccatccctgcccctgtcccaaagccaggcccagccaaaagcatcagcaatggcaggcagctccagtcttgccctgacccctggcccaagctctgagagctgaactgataccaaggtggaagccctaggcacatctagcaggggaaaggccaactcttcattttctacctcagtccctatcaggttatgtgaggagaccgattcctttctgttcctggactccagttccttatggacagggttgaaccctaatctcaaaaacctagtggcctagtcccagctcctggagcctgactttcctgatgccagccacctgtccagactgctgacagacaactgttgctgggacacctgctgttttctacctcttcctcagcctttgtgtggactttgagaattcatttttgtattctacctcagattagaattctaactgagaattcaattttgtattctacctcatcctcagccattgtgtggactctgagaattgctgccacctcttgtggatatttcagatggtggttcaagaatactcactctttgccacccttctccttgggaaggacatagttctcactgatgttcagcttgctcatatgatttgctctggcctcatggaggatggagtgtactttccctgacccttggcttcaggcttagtctcaggactttctttgtccaatgggacgttagcagacataatacaagaagaggcttgacatgtgcttgtagagttggactatgcactcttgcattctggtgacctgcagggagaagaacacacccagataacaactgcccctccagcctgggatccaggatgaacccatgtggagcagatctgagcagatccacattgagaagtgtagcccagccagatccatggttcaaagcccaaccaacatccagtaacccttagctatgtgactgggaattttgggagtggtttgctatgcagcaatagctgattgatacacttgggacatgtgtgcttatcccatttgactgaacttcctgggtccccatctgctccaagtcagttctcccagaacctaacccacatcaagagcaaaacttgtgccagttcccaacctttctttccactttctgtgttcctattttgcttctcatttcctgtgtaatcctggagaaaaaatatttaacttctgtgaacctcacttctttagggttgtaggtaatactagatataggtgtttgttaactctctaggacaattctaggcatacagaagatgtttaacaaatagtagtaagtcagccattccaggctaattcctgagaaacaggatgggcaccactccattgaggtgctagagaaacaacccaaaccctaagctggagactaattttacattttcaacctcccatccttgggcttgtttcttggttcccagcattctcatagcacttgtagttccctactatgatgtgtccactctcatttctgtcttctctgctagattagaggcccttacagacagtaactatcacttactcatctctgtatcctcagcctctgtttagcacagtgcctggaatagagtgtgtgcttaatagatgtttattaaaagaatgacttagtcatccaatgaatcaacgaagaaaaggaagaaagagagggagggagagagagaaaaaggagaggaggaagaaaaagggagggaatgagcgacagagggagggaaggaaggaagaaagaaagaagggaaaaaggatatacaaggatttggatggatggttggatggatggatacagggatgggtgaggatgtctgtacctttcgaagggtagataacaggtgactgcatggtttatggatggatgaatggagcccctcatccgtggggatgtccaatagcttcacactggcttctttttctatcccctctagctctcactcattcctctcctgtcacaggcaactcctgggtttaagtgtccttttgaacaaataacaaaactccaattggtgtgtgagcgcttctagcattctaattgtgaagcatgcttctgaatgacttaggagctaaggggagcttgaaaaagcctaagatgctgggagaaaatgagaatcatgacattttgaaaaggaaaccaattttctctaactaaaactgttgcctctgtaaaccatattataaatccaataaattcacataatgctatggtaaatccctcacaaaagagagaaggaggggggaaagagagagaaaaggataagaaaaatcttacaaagacttccaaagtcactcttctctttaaaaacaattgctttgatcctatgttactaactacctgaattcaaatacaggctccaccaattccaaggaattaactttggcaaatcactgaacctctctctgcctcaactccttcatctataaaatgaagatagtaatacctacctcattacattattgtgaggattattgagataatataggtaaagctcttaggaacctgccatacacatagcaagttataggggaaatgcacctgagagcattaagcacacgtttagaatgatcctgtatggcagatgcacctgaatgtgtgttccaagctaggaaatttgggagcggccaacccagagattcatcccttgactatgataagcatctgagcccccagtctgtcccacggaacacaggctgtacagggattgaggccctgagttttgggataaacgaagtttgccaggtagaggtcattaagggaagagagttaactgaaaatactaatatattagccgattttttgataaaagccacttgaggggtaggggagtgggaaagtggaggggtggggagtgggaattgttaatgagtacaaaaaaatagttagaaaaaatgaataaggccggacatggtggctcacacctgtaatcccagcactttgggaggccaaagagggtgaatagattcaatccaggagttggagaccagcctgggcaacatggtgagaccctgtctctactaaaaatacaaaaaaatcagcaaggcatgaaggcacaggcctgtaatcccagctgcaagaatcacttgaacctgggaggcagaggttgcagtgagccgagatcgtgccgcttcactccagcctggatgacagagcaagactctatctccaaacaaaaagaataagacctagtatttgctagcacgatagggtgactatagtcaaaaataatttaattgtacatttgtaaataactcaaagggtataattggattgtttgtaacacaaaggataaatgcttgaggggatggacaccccattttccctgatgggattatgcattgcatgcctgtatcaaaacaactcatataatccacaaatatacacatctactatgtacacacacaaaaaaaggtgtttttccctatctcctttgaataaaaagcattgtctttctgataatagaaagaaggattgaaggaaaatgcatataaactgcatgttgtttgcaagcagttgcagtttccttgcccagcctgccatcactgggctgtgtggttatgtcgtccagcccaccatcactgggctgtatgtaaggtggctatcttgtccagcccaccaccactgcaccatgtgtgtatgtaaggcagtctcctctccaacccactgccactggactctctcctccgttaggaagcccctaataaaaccccatgcctcaattgctggctctgggtctcttcttcagcctcttgaacctggtgccttccctgaggttaatagggatttggcacaatataagtgtataataagtgtgggcaattcttattactattactccctacactcacagtggaacacagcaccaggacctggtgacctagggaccatgagtagatcccacactgctccaaagacattcgtcctcctcgacagcctcacatatcatcattctctaccctgatcacccctaatgatcctgacactaactcctcccaagtctaatgccaaacatcatgtaacccaaatgtggatgtgggccatgtgggcaaggcttcatacagcattatattgtgagaaagagccaacacccaaaagtaattcaaaataattgaaatattacttggtatttcaaagaaatgtcaaagggagaagtacattctgaacacacaaccataaacatctttaaaatttttcctatcactgctgctttcaatattccacacacagcatttacccaaaactccctctctccttcacccaccctcaatgccggaccatgaagttcttctatttctcacccccttcatctcttcccatatttgttcttcattgggtagatcaacttaaccttctcacatcttagtgcttctctccatttctacctggattacctggattctaaataacaaaggtaaacccaggagctgaccaagtagaccagaattcttccccatagaatcagggaagatgttaaaaatactcattcttaatttttgtccctgctaaaccaagttatctgaaatctccatgcctttgctcaagctataatatttcttctgcctggaatgcacttcacttttttttttttttttttttaagagacagagtctcactctgtcgcccaggttggagtgcaatggcgccatctcagctcactgcaacctctgcctgccaagttcaagcaattctcctgcctccgcctcccaagtagctgggattacacgtgcgtgccaccatgcccagctaattttttgtatttttagtagagacagggtttcaccatgctggccaggctggtctcaatctcctgaccttgtgatccgcccaccttggcctcccaaagtgctgggattacaggcatgagccacatgcccggccacactccacttcttttaagaagcctttggtaggccagtctctctgctctgagagctgggagtggctgggagtgacttggagatgcagaagaggcagaggctggaagtctgaggtctagttttggtagctggctcacctccagtctgatttggaaatgcagaatgtgttcccacaaagcctgaaagaccactggcctggtatgtggtccaggggacataatgtcgagtagagagttggactagctgacccccaaaaaatcagattctgtggtattcgtgacagaacaattccattgcaggagaaacaggccaacattggcagaagagttggccatagccaccagttgcccctgtggtccttatgaggcaagcagctcagatttggagggtaatgcaagctcctccagaccagcaggtccatggtggcctctctacagccccatttccaccactgctccccatcccacaaagtgtggagcatggagcccctagaccagacacctttggaagaacaccttgaaaaatctcatctttcacacagcagtttattattttcaatgaattgttaccattgtcctcaccaccgcctgagaccaacaggagcagaatctcagctctgaccctaactccatgtgactttgagtgtgccacttctcctctctggggctcagttttcttgggagtttatcagtcaggataaactaagtgctatgctatgtaacaaacaagctcaaaaatcgatgcctttatactgcaagcattgatttattgctcatgataaataatcaaagtgagcctgtgagaggctgtgctctacatagtcacatgggcagccacagtctcctccaccttgcagctgcaacacctggaatgtaaggcttccatattcacatggcaagggaagaactgcattagactggaattctaactatctgagaagtgacacgcatgagccctactcatatttttttagccagaactaggcaccttggtgccgcctacctctgataacagaaagaaagaaagaaactgcaatataaattgcatgctgtttgcaagagcaaacagggagccaagaaacataagacaacatatggaatatctgcgtagtaataccatctctgccacaaggtgtgataatacttctattactaggtgactagaaggattaggtgaacaatcgttttgcaaaaaggctttcaacatttaaacctcagaaaatatttattgtgcagctactatctcctaggtcttgtgcttagtgccaggaacacaacagtcatcctatcctcgtggagcttactgtcttgtgtatgaggcagacaaaaaatcacctaattgcaccaataagagtgtcactaaatactgcaacagatgctctaaagagagatgtgtggtgatataatatgacagagagccttaattcatccgagcagtccaggaagacctctcttgagctaagatctgaaggatgggcaaggagtaagtagatgagcagttaaaaagaaggcagccagatgtggtgtgcacctgtaatcccagctatacaggaggctgtgacagaagaattgctcgagcccaggagttcaagtccagcctgtgcaacatagcaatactctcacgtcgaaaaaaaaaagagagagagagagagacagagacagagagagaaggtggtgcagagtgttgttggcagatgaaacaatatagacaaaggtccagtggcaggaaaggcacagcatgtttgaaggactgagaaaaagctggagaggcttgggtacagagaccaatgcacagcttggaatgagaggtggtcaagttcaacagagacccaaccttgtgggctgaaacaggatttatttgtcctttatcaccaaagcaaactgaggcaacatggttattatggtcaccattcccactttgaagaagtgtaaattgataccctgagcagccaggagacccatctagagtcaggagaggaggtgatattctgactcaccctaaccactgtgtggccacctccaaaagcctcaggacaattcaggaccaagaacattctctcccaccacgagaagaaacatttccttcctggagtaggttccacatcccatccagtgatgtgtgtaaactcacaacattagcctgcgctgggccagccccatgggccaggacaggttgaggccaagagatggggatagagatgactggggatagagaccccagtcactttcttttcatctcagcagtaccattattttatcatgtgactttgcgcaagcaatttccccttcccagccctcagtttctccatctctgaaatgcaggcattgaaccagatggtctctgaagtcccagcaacaggagttttaggtgtattttccggctgagtaatgaagggggaaagtgagtagactccaaaccagtctttatctggagaactgcaatttgccaaacaagaaaatcaaggggaaattgcaaagatgatgagggatggaccttttttaggaacaacaacctaatcacaagtcactgctagagaagaaatgtcacaaaaaccttgatttgcagctttagggagcagcgtgccatgggatacaggcaattaacaacgtgagaagcttccccaaggctcagatgaatcatgaacggcagtgttgatgggctggaaaggatgccaaacagcacatgatcaaaatcctagcctaattcatgaagtcctgtggagctgtcctaccaagcagtcatcctgcatctgcctagacaacccatgtgatggggacctttatacctactccccttttgcacagtgcccaacagagtgcatggcacacagcaagagctcaacacatatgtttgaacgaatgaactaattaatcaatagctgcagtgatgtccctatatctctcctggtacttttatctgtgggttctagtgctactctctagtgctactctagagcacctctgttctcgtgactgcctgtctcaggaagagatccccaaaagtagacatttattttggaggtgtttttaggaacccctgttgaggcggaggaactaagacaggttagcaacagaagccaacaagggatgtgttaatgaaaaggctaccactgtgggcaactgtagctcaatccttctggaaaacctctgggagatgatatagaattctgctagccaactcagcagccaccagccacatggggctgttgggtatttgaaatgtggctagtataaattgagatgtagaataagtgcaaaatacacaccggattttgaggacttggtatttttaaaaagtgtaagatatctcagtaatgatttttatattatgtaagattatgaaatgactatttttaatatattgggttaaatatagtgttaaaattaatttcacttgtttttcttttttccttttttttttcttttttgagactgagtctctctctattgccaggctggagtgcagcggcatgatctcagctcactgcaacctctgccccccgggttcaagaaattcttgtgcctcagcctcccaagtagctgggattacaggcgcccgccaccatgcctggctaatttttgtattttttgtagagacggagtttcaccatgttggccaggctggacttgaactcctgacttcaagtgatccacctgccttggcctcttaaagtgctgggattacaggtgtgaaccaccgcacccagctaattctttctactttaatttaaaagcatgtatgactcacacttatggctcacatatttctattgttcgatgctgacatagacgataccttagagttatcccacccaaggggtgaggaagctgggtttttacccacccatttatacccatcattggttgagtactgctcccaggggtataaaatccttagtatttcaacctggcccatgcaccagtgagcttctgcagccagagaaaaccctcagccagagttgcaagaacttgtcataggaacatgttcaggaatgaagagtgcagggcgatgtgggcagagcactgctaccctgcccaacaaaaatctgatggccatatctatgtcctgccctcatgtcccagcctctcctatccaaagtgaatggcccaatttctttctacaagtccttctcataaaatttgctctctgtcccctcagcttctggactgccttctccaaacacataccagttggtcactgtcctttttacagggtgctggttgagatggtctatccattcacgggcttcttagccctcccgagccaaggaccccttacagattctggtaacttcagggaacttctcccctgaaggaaattctttttaggccatgtgcaccattctcgcaaaattttgcattgcactttcaaagggttcacaaccccagtgtccatacataggcctttccaaaggtcagtgaacccaagattgaaaaccccagctctaatgcttgtctgacttcttttattcctccactacatatgttcacatctttctttctgaatgctttcaattttcttagcagaaaaggaacgtagttcctaaagctgcaagtggaggcaggcaccccagagtgatctgctggccatagataaggagttgctgagcgcttggggttaccccccacgccaatccccattgactcactggctcctaataaacagctgatttgtgaagatgagcctcacaggcaaccaggatatcaaggcagagaatcctctgcccacagggcacagaatgataaagccagaagaggccaaggacatcagcatatgttatgcatgccagcaaagttgagcttacgcggcatgtcattgatccttgaaataactcagtgaggtatgtggggctctcatcttcattccacagatgacactggaatcaagatagagacagtacaactcagaggagaggagtttgcccaagaacacataggtagcaagaggggaagccaggacttgaactaacatcctctgagtcccagccctatatccctttatccccatcaagttgctcctactggaggaaactgctggctgtccacccaagtccagctcctcttactccacagtagctgtgattgggacatggctgttttgccaggaacagcagtcccagcttctctgcaggccagggatggggtatgagtggacacaacacgtgccatttctgtctcacttgtttacgaaaacatgtatggtccttatggccctgagtttgcacatttttctcctcctactgacaggatggcaataataaaagtgaccttggaagccacataaacatggcagagtcattaattaataagactgggatcctgaacatccatgtggagcaaaactacctgctgacctggaacatcccacctctgactgttatgtgggagacaattgacttctttgttctttaagctacagtatttgggagtcttttgttctagcagctgagccttttaccctaactaatacacacccctagggagcagagtagggaaagaaacttacatttaggctttctgaggccctcccagtttcaccagatgtcaagatggcacataatatgaggccttaatttttggcctcataccacgccacagaatgatccctaaggattacaacatcatcagttcaggcgacctcaatatgtacaggatctcagcccagagattacagaatctcagaacccaacacataagtgctcactgctggccccagtgggctcagagctgtgattcaccctgagaggggaaagggatggaaacactctgttatttgcttattccctactctccctccttcctgtatattaccctgcctcagctaggtcaaaagtccccaccccccactgtttgaatccctcattttcctcctttctcctatgtgcaaaacaaacatacattaatacatctaccttttgctcttataagaaaacgggctctgtaacacagacaactggttttggcctacagcactgaacacaggagaaagccagctgcccgtgataagggtccatccatcctgggaccctgccctgcagacccctgcctcctgcccttctgtctggttgctcccagtgaccggctcagccaatcagagggctgcatttctttcggcactggcctttctcaacttctagaatcaactccaggcttgagatgccatctgggctgaacccacagaaaaggatgaacttcgtcttgcttttaacatagctcaggcatccagcacataatgaccttcaaaaccctgcacctcacagaaatgatccccatgaaggcatgagtggatacgtggccactctgctggggtatgaacttccgggtgccatgctccaaaatcctcctcagctgtctcattccagctgcattctggagcccagaccccatccagctcctcaagctgctgtccagtgctgatgtggagtgctgtctgggaaccatcgccttgcccaagtgcatctagaagccttcctagagtgtggctaaatccatgttgtttactggggtgtccctccttctagacttattaaatccactttccctccattagaaataaggaagtgagtcagagctgccacttcaggcacccagggacaatgaatgacccccacggtccagagggaatccataaaccagaaaagaaaattaggatctgacttcctggagaagcagagatgctgccaaagctctgccctaagttatccagtgggtggcctactgggaacttaatcatatttgggttttttttcctgaagtaatcttccctatttttggttagtggggtgtaacacctctggaaaggaggggaggccaactggggcggttctgatgactaaaacccgatatgagtttgcaggggctgccccagaccgggtagtttcaacagaaatttattttctcttgattttatttatttttattttattttttattttttgagactgagtctcactctttcatccaggctagagtgcaatagtacagtctcggctcactgcaaccttggcctcccagtttcaagcaattgtcctactttagcctcccaagtagctgggactacaggcatgcaccaccatgcccggataattttttgtattttagtagagatggggtttcaccacgtcggccaggctggtctcaaactcctggcctcaagtgatctgcctgcctcggcttccccaagtgctgggattacagacataagccactgcacccagaccattttctcatgatttcagaagctagaagtgtaggatcaaactgttggcagggttggttttgttgagccctctgtccttggcctgaaaatggccatcttctccctgtgtcttcacagggtgcatgtacatatctgtgttctcatctcctctagaagaacaccgctcatattggattagggtctacccctatgacttcagtttgccttcattacccctttcaaagtcctatctctaaatacagtcacactgtgaaatactgggagttgggacttcaacatatgaatttgaggaggttggagagacacatttcagcccgtaacagaccccacccattccccttgggagagggtcagcaagttcagcatgcccctagggctgggctttattttcctggaagacccagaagtcctgtcatgggagtcgagaatcagaaggagcccttctgtgcaagacggtctcaaggaggagagaggcagtgccctgagagggagggtgggcggagggaagaggaaggggcactgaattggggaaaagacgcctggtcaccacgttttaacagggatatgaataaattcattgtgcctaaggaagatgaacagactgtgaaaaagccttcaaaatcacaagggacatttagcttgaagaggaaaagacatacggagtaaaggtctctgttttcacctccctgaagaaaggtaatcaatgtgccccagaggacagaaccaggacttgtaggtagaaagcaaagagaggcatgcttcaactgcaagaaaataaaagtgttccaagcagtgaaatatttgaccttggagtaaactgctataataagtagtatgctcccttcactcacagtatttcagtcgggctgaaagatcatcggggtgcctagaggagaagttttcatgcacttctcaaattctatgatgctccaaatcagagggttggacaaaataattgtgcttaaaacctgcccttgtggtcctcttgtctcatataacacttagcaatctctctctttgcagactggctgaaatgcaatgagagtgcctgatgacacataatttttggcacagaattcacgacattcatctcaaatgtccaagctactactataaattaacagatcttcacacacacacacacatacacacacacacacacacacacatagctcatctcaaaagtgtgagagaacttccgaaccatgtgagaaaaccaaggcttttggaagaatatggctctgcgtctgtcaagtcaggaatccatccttctagaagggcacggtagtcagaggaaagtcccctctcctctaacacacacacgttgatgtccacctcctaatccccagcacctgtgaatatggtaccttacaaggcaaaagggactttgtaggaatgattaagttgaaggactcttagatgggtgacattcccctaggttatttcgctcctccagtcgaatcatgtgagtcctcataagcagagatgcctctcctgactgcagtcagagaaccagagaggcgcagcaggagaagaacttggccacaagccaaggaatgcaggaagcctctagaagctggaaagggcaagatgatggattcccccctagagcttccagaaaagatgcaccatgtcaacattctgatcttagcccagtgagaccaacatgggacttctcttctctaggactgcaagataaattaaatacatttgtgtttttaaaccacttgtgataatttattagagcagcaatagaaaactgatacaaagagtcaggcactctgaaatcataaaacaaggattcaactcccagtcggcagagtcctagctgtgcaaacttgggccaattaattaacctctctggatctcaatcggctgctaatggggccgttcactactctcaaagggctgatgtaagtattaacgtagataataaaccactagtaacgtgtctggcacagacagcccagcagatgttcccatctcttcttttccaccttatttgctcctagcctactgtgttatttgcgtcattgctccttgggaaatgaggaaactgggttccaggtaagcccgaagataggcacaataacatgcagctgatgaaagttaaagtgggatttgcagtctggcttcaggaagccccacttggaggcctgctcgcagagcagccagagcaaatcccagccacagcacaaagggctccaggaaccacattcttagagatcactccaggaggtgccctgggggcagtggccaatgataaccaggagcataggctgtgggactatactagatcaagggctaagatttccctagggtcaaggtgttctgattcaactggactgcccccggcccccaggcttcatacagggtgctggtgaggaattgtccaggtgtgcaggaatgcggggaggtgtctactggtgatctgagcagtaagagcagcctctgagggggtgatatttttaaaaaacaggatcttgctgtgtcacccaggctggagtgcagtggctccatcacagctcactgcaaccttgaactcctgggctcgagctgtcttccctgcccccaccctcccccttccccaccccccaccccccaccccagcctcccaagcagctaggaccactcgggacctatgccaccatgcctggctaatttttttttttttttttttgtacagacagtctcactttgtggccaaggctggggtgaccctgctaatggagctggcaatgaactgcattttggaagctcaagcagtcactctcgtccaggtgagcctgaaaagtgtcgtcactgacatcgcaggtcagagcaattgaatgaactgtggaattcctgctgtgagtctgttaggctgcaggatccaggatcctccacccttatctagttccaaaactttttatcaccccataaggaaaccctgtacccagaaagcaatcatagctctttgaccccctcccctgacaaccactaacctgctttctggctctataggtttgcctattctggatatttcacataaatggactcatacgatatgtggcctgcggtgtgtcttcttgcacttagcgtaatgtcttggaggttcatccacattgtggcatgcatcagtacttcattccttgatgtggctgagtcctatttcattatacttaatttttttaacaagatgttccacattttcattttgcaccgggctctgaaattatgctggtcttacgaagctctcttacggggttgcagaaaccggtcactctcaactggccccttgcctccccgccctcctctctccatgcaccctccactgtgcagccaaaatggtcttccttggacgaagcctaagcatatcatctctgtgcttaaaatcctcctgtgactgacacccatcgccctcacccctaccatatctcggccccttggctaaaggatccagctctacaaaggagccaggctgtagggaacctccatgccttcgcccatgctgccactcagcctggaaggccctccccccactgccccccttcttctcaaaattgactccaatacggtaactctatgattctaaggtcttcatcctcaagaatgaggtgaatggttaaagggcccttagctcgctaatgacaaagatgcaatttgcttcaaagctgaccttcaggaaagaggactaaaaaaaatagatgagtcaatttaatcttctgcactgacacttccagggaccatagaatgaacttacaagggaacttatgtaagttcctttgtgagatataaataagcacattaaagtattcctgcttctgtccagcttaatggccaagaaactaattgtcagaaatcggaaaggagctgaaataaatatgggtagagtgctgcttgatattatgaagaaatctggcccaaaaagtaaaggcagggacgcagataggggatgtccagctgtccagtgggcaatttttcattgtggtcatgaacttttttctgagacatagttttttgctcttgttgcccaggctagagtgcaatggcacaatctcggctaaatgcaacctccgcctcccaggttcaagcaattctcctgcctcagcatcccgagtagctaggattacaggcatgtgccaccacacctggctaattttgtatttttagtagagatggggtttctccatgttggtcaggctggtcttgaactcccgacctcaggtgatccgcccatctcggcctcccaaagtgctgggattacaggcatgggccaccgtgcccagcgctcatgaacttctctgctttctcacataaaccatcattaaacagtagctggcaccacctggatgccacttcctgccaagagtcatgagggcatggtgtgcaggggacagtggggaccctaaggtctagtgctcatccatctggcttgtcctctcagtagcaatgtcctctagggccaaggactcctgacaccagaacctcaactgacagcagttgcatcacaggtcagtctttgtggctgggcacaaacctgcaggctggacttcccagctgtcaaggccaccccctgccccctctgtcctcccctcctctctcacctggccccggatccccacctccaagatgttgctctatctgggtgatcatctcctatcttcagtctttcccaccccaagattccttctcgcccacccttgaaggtgcacatctcctgaggtgggcaaaagccccgccttgactctgcctctctcccaagccagtagctcctctccctctttgaccaccccctatcaccaaacacagtccatccttcctcacctccctgcaggctgcccagctccagcctcacactccacagtccttcatctacagaacaatacgatccctctgaaacatatctggaccaccactgccctgcctgaacctcccaggagactttcactacccccagaagagggcaagtctcaagctgggcattcaaggaccatgttgacctggccgccctcacttcttggctgtcagacaccctgcagccactcctcccccacttttggccttcaacctctctgagtctctgtttccccatctatgaggtcagtggtttggaccagctaatccctgaggctcctccacggttctaaaaaggaaacacagcacacacgcatgtgcgcacgcacatacacacacacacacacacacacacacacacgtgggcacacaccacttaggctttgttctgagtacctaactgcctcccatagaaaactcaagaacaggaggtgaggatcccagcggaagcagtgggcgcattctctctcgtgctttttttctctctgctttcaatgtattttaccatcttctgaacaaaaatagcctgtttgattccctatgggaaaaaatagaaaagaagataagagtcaaattagtgtccactctcataaaatttttttttaatggaaagagaaggagataaaaagcaaaaaggtagagacatcaggcccacaactcaaccagaaaacttagctgcccatggctggagatccagatggggccagagaaactaggaaagttgaggcagggataaatccttgcctaaggtctgggctccctattgggaccctgctaagaggtatcataagtcatatatatatatatactttaagttcgggatacatgcgcagaacatgcaggtttgttacataggtatgcacgtgccatggtagtttgctgcacccatcaacccgtcatctacgttaggtatttctcctaatgctatccttcccctagccccccaacccccgacaggcccaggtgtatgatgtccccctgtgtccacatgttctcattattcaattcccacttacaagtgagaacatgagtgtttggttgaactcatccttcttcatggctgcatagtattccatggtgtatatgtgctacattttctttatccagtctatcactgatgggcatttgggttggttacaagtctttgctattgtgaacagtgctgcaacaaacatacatttgcatgtgtctttatggtagaatgatttataatcctttgggtatatacccagtaatgagattgctgggtcaaatggtatttctggttctagatccttgaggaatcgccacagttcttccacaatggttgaactaatttacactcccaccaacagtgtaaaagcattcctatttctccacatcctctccagcacctgttgtttcctgcgttttttttaatttttaaattatttttatttgttttaccatatatttatgggatacatgagatgttttgatacaggcatgccatgtgaaataaacacatcctgactttttaatgatcaccattctaactggcgtgagacagtatctcattgtggttttggtttgcatttctctaatgacagtgatgatgagctttttgtcatatgtttgttggccacataaatgtctccttttgagaagtatctgttcatatcctttggctgctttttgatggggttgcttttttcttgtaaatttgtttaacttccttgtagattctggatattagccctttgtcagatggacagattgcaaaaattttctcccatcctataggttgcctgtttactctgatgataaagagcttctgcacagcaaaagagtcacctattttttagagcaacactgacacatatcagctcagacgtagaaccattccttctctcttggtttatcagataggaccaagagctcacctgccagtgggtggaccaattctcaaaatataaagtatataattctttatactggaggaagagttcagcatatcttgttctcttcttggtcctcgcagttgcactgatgtatgtctggccttctggggaagaaagaaggttgagaaggtgttttggggtccctggaggactgggaccctgattgttacctctgggtagtgggataggggatgtgcaatgaggaacggagtctttcagtcttgtactttgttcacatcttaattattttattctttttcaattaacatgctgtagttggcttgagtttttgttttattttgtttgcttgtttttttaacatacacagagatgacaggcgaggttttattttcaaggttcttcaaagaaacaaatcaattctggaaggccaaattaacttgctggccatctccagtttgttaaactacagtcaataacaggggttggcaaaccatgacacacaagccaaacccagcctgccgtttgtttttataactcctgcaaattgagtgtttttttatatttttaatgtctctttttaaataaagaaatctatctcataatatgacatgtgaaaatatgaaattcaaatttcagtgctcataaagttttattggaacatagccatgcacattcatttacacattgccaatggctgcttttgcactccaatcaggaaagactatatggcccataaagctaaaaatatttactatttggcctgtacagagtttgccaatcccaacaacatcctgttgtctcaggtcttgaagagttaagaacacattaaatcatatatttaatcaaacatcttgggtatatttttgcggaactgtattggaaacattacttaaggacttcatagtgttttcttctctgtaaatttttcactatggaaatttttttaacatattcaatagtagacagaatagtataatgatccccatatactcaccacccagcttcaacaattattatagtattaatattattttgattaacatcaatttatggcagacctagttttaacgataccccacccacttacctttcctgcattattttgaagcaaatttcagaaaggatataatttcatctgtaaatatttcacagcaaacactgttttaaaataaaattttacaaccagaaggagacggtgacaaagttgtgcgtaataaggaatttgcagcagaagagtcatgagcccatggaggaagggggtgtgggtggaagacacactttaaaactgattgagaaatgcacgtgtggcacaccacatcttccaagcaaaactcctggctgatagacaatcaccatgggaataggaatgtctctctcccatctattgtgatcaatgccaagaaaaggccgggcgcggtggctcacgcctgtaatcccagcactttgggaggccgagatgggtggatcgtctgaggtcaggagttcaagaccaccctgaccaacatggtgaaaccatgtctctactaaaaatataaaattagccaggtgtggtgacgcatgcctgtaatcccagctactcaggaaactgaggtaggagaatcgcttgaacccaggatgcagaggttgcagtgagccaagattgtgccattgtactccagcctgggtgacaagagcaaaactcttgtctcaaaaaaaaaaaaaaaaaaaaaagccaagaaaaatggatggagcaagggacaaggaaagggagcctgttcatgtaattaaagactgggaaggagatagacaagctgtcagcttcatgagttcctgaaagctgggtgggtcaccctggcagtgagtgatgtctgatctttctcttcctttaatagccagggtcaaccctgaacaaaggagaagcaagctgcctttgtgagtccagggtccctctttggactttttcccctctgtcaccccaagaacccaaaagacataggggaaataaggaagaaagagaagagtcacatcaacggtcaggactgcaggggaggtaagtgaccttaagagaagaggcagcattgaaaaggtaggaggaggccagaggccgggtgtggtggcttacacctgtaatcccagcactttgggaggccaaggcaggcagataacgaggtcaggagttagagaccagcctggccaatatggtgacaccccatctctactaaaaatacaaaaattagccgggcatggtggcgtgcacctgtagtcccagccactcaggagcctgaggcagaaaaatcacttaaatcgagaaggcagaggttgcagtgagccgagatcacaccaccacactccagcctaggcaacagagcgagaatccatctcaaaaaagaaaaagaaatgggaggaggagaagcaggagcaagagaagaggaaggaagcttcccaggggggatcaggcccaccaggcagtgcactctgtttacagagggacaaattaaccagattagaatcctgagagccaagtttacatgtcaacatggccaggcaatagtaccgttagtcaatcagacattaatctgagggttgctggggagatattttgtacaggtggttaacatctacaatcaattggctttaaagaaaggagattatcctacataaggtgggtggatctcatccaatcaattgaaaggtcttaagagcaaaattgaggtttcctaaagaaagaaattctgcctcaagactgcaacatcagcttctgcccaagagtttccagtcttccagcctgccctacagatttcagacttgccaggccccacaatcatgtgtgtcagttccttgaaataaatttcttcatacacacacacacacacacacacacagagtatatttactgattctgtttctctggataactgacacatatccttaatctttctctccctctctgactctatacagttgtgataataataattaataatggccaggcacagtggctcacatctgtaatcccagcactttgggaggcaggagattgcttgagcctagaagtttgagactagcctgggcactatgatagcatgtctatgctatcatagacccatctctaaaaaaacaaaaaacaaaaaaaagaaaaaaaaagaaagagaaaagaagaaaacaataagcaataatacccaacatttattgagtacttactatgtgccaatgtgccagatagtgttttcagtgctttacctatattaactcacccaatcctcacaattgccccatgagaatattattgtgcccgttttacagatgaagaaactgaggcacagaagggagatcactgtgagcctatagcaaaaggctaatggagcctgggaacacgggcaaaaagggcatttgttccttcactgcaggctcacctaaggtctagagtgcagttctctacccccactggaggcaagaggatatatccttggacacagggtagacaggaagaaaatcatcagaaaccaaagcagattgtactaaatctttctgattctagcatagcagcatcaacagagcacaaagtcatctcaataaattatcccatcacatttgttataccacagtgaacattttaatatagtaaatctttccattttcttatttacactttccttattttatcttattgacgttgtgcttgaggagttcctaattcaaagatacctgactcaagccttgttactagggaagagggagtgagaagacgctgcagacgtccagagaagcagacagatagtccacgatgccaaagaatctttgctggaggaactgcatcaggcggggcctgagaaccggtggtttctcgccagcatccgtcatccggctgtttctcagctccggctccaatctggagaccgagccatgcctgtggatgcttcccaagaaggatctggtggggtggggcggaattttttttctccctcctctcccttgaaaacatatttgactgctttgcaatccaaacgcaaacagcctgacaatgtgctgaagtgccctgaaatgcagggagctgggccatagagaggttcagaggagggattcctcctgcaaggcccttggacaggagagccagggggtctctcaataagggggccggcctgcgggaggaccttgggaatacgttctaattttctaatacaggaaactggaagagccaaatgccttgggaaagaagggtttgttttttaaactgggagcctcatacatatatatgagattaatattttatcctataagaaaagtctacagttgggagaaggcagtgggggtggggggcaaaaccctaacacaacatgtgccatggtgactgctggaaatgcagcccactgggcacacaacccaagaactctgcgtgcatgctgcccctaggctgggagtgggctttgggtgagctgtctgttctcccggccaggttctcacaccagcctccagccagcagaacctagggatatctgaaaaaatgtcccctcagcacgcttctcttcagcccctcaattgcccctaagctcttcccaccatgcttttcaaccatcccttcttttcctttctacccaggatactgttctttgaagcttcacggttaagccagactgtgtcccactggtctcttggcgggagggtctccccattagagctccctgagagggactgcaccctgggaagttcagtctgaggagattccatcccatccagctggtcttcccttcccctcccctccctttcctcttctccctctcctaacactcactgacaatctactcttagcaggcactgctctcagggctggagaaatagtaatgaacaaggcagaccaggtccatgctcttcttaatcatttgttttttgggggtgtgaaaagttaaagtagaggttcctcttcaaagagactttcctgtctaattaagaataaataataacttctcttagaagcaaaatttagtccgggagggaggtggggggtcagccccccacccagccagccgccccgtccgggaggtgaggggcgcctctgcccggccgcccctactgggaagtgaggagcccctctgcccggccaccaccccgtctgggaggtgtacccaacagctcattgagaacgggccatgatgacaatggtggttttgtggaatagaaaagggggaaaggtggggaaaagattgagaaatcggatggctgctgtgtctgtgtagaaagaagtagacatgggagacttttcattttgttctgtactaagaaaaattcttctgccttgggatcctgttgatctatgatcttacccccaaccctgtgctctctgaaacatgtgctgtgtccactcaggattaaatggattaagggcggtgcaagatgtgctttgttaaacagttgcttgaaggcagcatgctcgttaagagtcatcaccactccctaatctcaagtacccagggacacaaacactgcagagggccaaaagggtcctctgcctaggaaaaccagagacctttgttcacttgtttatctgctgaccttccctccactattgtcctatgaccctgccaaatccccctctgtgagaaacacccaagaatggtcaataaaaaaaaaaaaagaagcaaaatttactcaaagacctgtgctaacattactaggtatctgctagctgtaataaagaaatcaacgtactttgtgttctttgctcccacaatttgccctggcatgcttaatactagtccacgcaagattaggtcatagcctgtttgtcttccttctttggaggtgtttttacctttctcagcattccacaagttacttcctccttcctttgttttcctctgcctttgcctcttttagaaggttccaagttgctagccaatcgggacacatacagaatgtgaggtcccattctagccaatggaaaccaggcgcaacagtagggtggacacgtcaggttataaataaccctgtctcctttgttcagtgtactctcatggcaaaactactggcgagtgtaccctttctgcaaaaagtaaaaattgccttgctgagaaaattaaattgatgttcaagtgctatttctttatggcaccagggaacaagcatttcaaacaggggctttgggggggttattttatttattttttgtcagaacatattattaatttgtttatgcaacaaatatttactgagcacctactctgggccagccactgttccaggtcttggggatacagaattgaacagacagaacaaaaatccctgccctggtagagtttgcattctatgaagacattaaatcaatcatgacaaaaattattcattcccaatgtgtagctgtgaccatgaaatagcacagggtgttagctcaggacagaaaaaaaatccagcctgatcaccccacaggaacagctttaattgaggcttcctggaaggggagtcacctaggagaaggggagggtgatatcatttggatgtcccacccaaatcgcatgctgaaatgtaaaccccagtgttggaggtgggacctggtgaggtgtctgggtcatgggggcttggttctgtcctctcgatagtgaattgtcatgagatctggtcatttaaaagtgagtggtaccccctctccaccctgccgcccacacacactctctctcgctcctactttcgccatgtaatgtgcctgctcccacttcaccttctgctgtgagtaaaagttctctgaggcctccctagaagctgagcagatgccagcaccatctacagcctacaaaactgtgaaccaattaaacttttttcttttatataaattatccagcctccggtgtttatttatagcaacccaagaaccacctaacacagagggtaagaagaagggctccaggcagagattctggagatggaagacaggatcatttggaactgaaagaagaatggcgtgagagaacctaggaagaaagctgaggggtggacaaggctcagccacacacagcctggtaactgaggattcgcgtctttgtcctcaaaacagcagggagccacagaagtgttttaagcatgggagggacactatgaggtgtgtgtttataaaacatggtgctggtggctgggcagagaaaaatggcaggagggacagagtaaaagcagaaagacaaaggcagagctagggcaggagctggggaggtggtggtggtttcgaatacagtaaaggctgtgaagatggagagaaaaaaatggagggaaatttgagaagtaggcctcactggtaaggaaactcactgtctttattttgctgcggttgctgtaacagagtaccatggactgggtggcttaaactgcagaaattcaccatttcacagttctggaagttagaagtccaaaatcaaggtgtcaggcaggatcggttccttcttagggccagcagggaaggagctgtcccaggcctccttcattggcttggaggtagacattttcctattcttttggcgtcccctctggctgcatgtctatctgtctccaaatttcacctgtttataagaataccagtcatcttggattgaagcccaccttcattttaactggaaggaccttatctccaaataaggtcacattattagggacggggaattaggacttcaacatatgaatttggggaggacaatttaatccataatgtggggtcctaataagtaaacaacaatacagaaggggctgcaggtttcaggggaacaatcattctgagagacagataatcacagacaacccactgccacaacatcctattccaaatcctcattccgcatgtagcctcagcagcatgaccctacctacacaccttatctgcacgtagcccctctggtagtaccctttaaaacttccctccagcccctgcttcttggcagacagccctttctctgtagtactgcctgttgcacccttgcaacatatctttgtactttctctagcaaatctgcctttatttacctatgactgtcttggtaaattattttactgcctgtgatgccagccccagccggtctcacccgcaacacataacactaagaaaagtcctgccgggtgcagtggctcacgcctgtaatcccagtactttgggaggccaaggagtgtggatcacctgaggtcaggagttcgagaccagcctggccaacgtggtgaaatcccgtctctactaaaatacagaaattatccaggggtggtgatgcacgtctgtagtcccagctactcaggaggctgaggcagaagaatcgcttgaacccgggaggtagagattgcagtgagccgagatcatgccactgtactccagcctaggtgacagagcgagactccatttcaaaaagaaaagaaaaaaagtccaaagggagtgagaagaagattaaatgtcctttcatgggtttagagagaccggttacagcaactctgctggcatccctcttacctgcctagactgtctgtgtgagggtttgcttgtttgcttgtttcagatgatgccttccagagagcaccacccaactcttgagatgcccatcatttccaaagatgaaatctcaggcccaacagacattcctgctggatatcttagcctggggagggacaaaagagcctgaactggccataaagtgtgtgccagcaacacctaagtaggacacccaggaaggccaagaagggaacccagtaaggggcatattttccttctttttccaaaaacgtccggatatttatcgcagtattactgtctcctcccagaggtccccacatctgattcatagtcacttgactcgggggtgcttgttaaaaggcagcttcccaggccccacccttggggattccagggtgagacccccagactgctatcttcctcccatgccccagctggctgtggtctccagtggggtttggaagctgccgctccaccagcccttcttccacggcctaaagatagacatgcgctcagggctgtgcggagcccggaggttttgatctgtggggaactggcacaattcctggcccttgtttgtccctcgaagttgtctcaaggcagaatctaatttccatttctattcctgcctctcaactctgactacttcagcaaatgcctttcaattgccccatttttttttcttaaagaaccacctctaacttcaatttatatatatatacataaatgtatacatatgctatttcccctgttccagaagctttgtgctttctacctcagggaggggtttagaaaaagattttatttgtcctacctttgattcctttaagtcaacagagacagccttaacatgactttttttagagaatggatctcactgtcgcccaggctgaagtacagtggggccgatcatggcttactgcagcctcgacctcctgagctcaagggatcctcccacctcagcctcccaagtagctgagactactggtgtgcatcatgcccagctaatatttttatttttatagagacaggtgtctccctatgttgcccaggctgttctcaaattcctggcctcaaacaatcctcctgcctcagcctcccaaagtgctgggatgacaggcatgagccactgcttggccttacatgatattttttttttaatttttttagtatttattgatcattcttgggtgtttctcggagagggggatttggcagggtcataggacaatagtggagagaaggtcagcagataaacatgtgaacaaaggtctctggttttcctaggcagaggaccctgcggccttccgcagtgtttgtgtccctgggtacttgagattagggagtggtgatgactcttaacgagcatgctgccttcaagcaactgtttaacaaagcacatcttgcaccgcccttaatccatttaaccctgagttgacacagcacatgtttcagagagcacggggttgggggtaaggttagagattaacagcatcccaaggcagaagaatttttcttagtacagaacaaaatggagtctcctatgtctatttctttctacacagacacagtaacaatctgatctctctttcttttccccacatttcccccttttctattcgacaaaactgccatcatcatcatggccccttctcaatgagctgttgggtacacctcccagacggggtgacggccaggcagagaggctcctcacttcccagacttggcggccgggcagaggcgttcctcagttcccagacggggttgcggctgggtagagacgctcctcacatcccagacgggctgccgggcagaggcgctccccacatcccagacgatgggcgggccaggcagagacgctcctcacttcctagacgggatgaccgctggaaagaggcgctcctcacttcccagactgggtggcggctgggcagaggctgcaatctcagcactttgggacaccaaggcaggcggctgggaggtggaggttgtagcgagccgagatcacgccactgcactccagcctgggcaacactgagcactgagtgaacgagactccgtctgcaatctgggcacctcgggaggccgaggcgggcagatcactcgaggtcaggagctggagaccagcccagccaacacggcgaaaccccgtctccaccaaaaaatacaaaaaccagtcaggcgtggcggcgcgcgcctgcaatgccaggcactcagcaggctgaggcaggagaatcaggcagggaggttgcagtgagccgagatcgcggcagtacagtccagcctcggcaacagagggagaccgtggaaagtgggagacagagacgagggagggaggagaccgtggaaagcaggagagggagcgggagagggagagggcttacatgatattttgatcagacttttttttttttttttttgagactgagtttcactcttgttgcccaggctggagtgcagtggtgtgatctcggctcaccaccaactctgcctcctgggttcaagggattctcctgcctcagcctctcgagtagctgggattacaggcatgtgccaccacgcccagctaattgtgtatttttagtagagacgggatttctccatgttggtcaggttggtctcgaactcccaaccttaggtgatccgcctgccttggccccgtaaagtgctgggattataggcatgagccaccacgcccggccaatcagacccgtttaatgctggtggagatggcctctggtgggccacacttaagcaccactgtggaatggcccctgactgatgctgctagttccttgcctgcagtccctcagcacctacctccacacactgaaggtcacttagggcaaacattgcaactctccacctgtggctacaggtgcatggccagtgcacaggaagatagatcaggaattgatggatagatgccccaacttccttatctataaattgggatacctctaaggcaggttctatactggatcccagttccccaaatgaattgagctctagtcgcccacagtggtaacctgctggataacacgccattttctggcttccttcccttctctgtctcacttcccctactcctggaccagtgtttcttgggatgacatgccaaggatattacttgtgctcaaatccttatttcaggatctccttctaagagaactcaaagcaagataagcactattctaaactgttcttcctgtgctagaccacagcttactcaacaactcaagtccaagactgtactatattttgaattttactagaggatatttagggtgcagcaccgtagacgttagaaggtttgccttttttttttttcttttttttttttttttgacacggagtctccttctgtcacccgggcttggagtgcagtggcgcgatctgggctcactgcaagctccgcctcccgggttcatgccattctcctgcctcagcctcctgagtagctgggactacaggtacctaccactatgcctagctaattttttgtatttttagtacagacggcatttcaccatgttagccaggatggcctcgatctcctgacctcatgatctgcccacctcggcctcccaatagaaggcctttttgagcaatgttaaatccaatcccgtaattcaaactgagtgttcctctgagactttggaccaaattgggcttgaagctccaataaattgtcagcatctgcaaacccatttcggccagcataagccataagagtttttggaggtggattggaaaatggtgaagctactttggaaaacagtctggtagttcctccaagtgttaaatatggggttaacatatgacccagcaattctcctcctaggtctgtacctaaaagaactgaaaatacatggctccacaaaaacatatacacaaatattcacagcagcagtattccaactagccaaaaagtgggcataacccaaacgtccgtgaacatcaattcaactaataaataaaacgtggcatacccacacaatggactattattcacccatgaataaatgaataaagtgaatgaaatactaatgcatgttacaaaatggactaagcgtgaaaacattatgcttggtgaaagaagccagtcacaaaaggccacatattatacgatttcatttctataaaagttcagaataggcagattcacagaggtagaaagtaaattagtggtttctggggatgtatgaagagtgactgctaatggatatgggatttcctggggggtgatgaaaatgttctcaaattaaacagcagtgatggttgtgcaactctgactattctaaaaaccacagaattgtattctcttacaagatgaatttcattttatgtgaactatatctcaataaagctgttatttgaaagagaaagatgggggaggggagttgagattttttgtgtttctggtctcctgtgaaaccacacctctcaatttatatattcatttatttattagaggcaagctcttgttctatcacccaggatggagtgcagtgtcaaaatcatagcccactgcagcctcaaactcctgggctcaagggatcctcccgcctcagcctcctgagtagccaagactacaggcatgcacaacctcacctggctaatatttttaatttcttgtagagaccagggtctccctgttatccaggctggtcttgaactcctgggctcaagtgatcctcccgccttggcatcccaaactgctgggattacagatgtgagccaccatacacagcctcacacctctaagttttttacaattttctatagctcttcaaagccctgtcacaacctcagtgggcctaaaagtctggctgtgggtcttggtggcagcaaagctgaattccaagcagaggtggggtatggccggaacttacacccatatctccagccatgtgtcatatgcacaggcagaagccaggcagggccagggcttggataggatcagactaagactcaatggagccagggtggggaaaaagccagggccacacccagaacttcttcattttccagaaaggcagtaagcatagccatctgagaaggcccttagaagcctagaatgatgagtccatcaaatccaggccaaattgctggagggttgctcatggaatccccacaacagccctgctccatggagattttttttctgagacggagtttcgctctgtcgcccgggctggagtgcagtggcacaatctcggctcactgtaacctctgccttcccgtttcaagcatttctcctgcctcagcctcctgagtagctgggattacaggcacccgccaccacacctggctaatttttgtgtttttagtagggacagggtttcaccatgttggccaggctggtctccagctcctgacctcctgatctgcccaccttcgccccctaaagtgttgggatcacaggcatgagccaccacgccctgccatggtgatcttaaagtaagagtatgcagttaactataaactagaaataaaacctatgctatagagctgctgtaagaagtaatgagttgatttacatcaggtgcctggcatacagtaggaagcctaaatgttggctccattcttcagtacgaaggctgacagtctgaagttaagtgcctgctcctcaatgtagatcaaaagactgagagacacaatgagttgtggcacacataattacaagatggagagaggagggccttaaagaacatccaattctacacagtaaataacaacttgagaaacaggctcagagagaggcagcaacttgcccatggtcattcagcaagatggcttggtcattcaaagaaagagcaattccatattcccaagttttttccctaaatgccaaagagcaaaacaactcgtcctccaataatctttggcaactctttataaagatacttctctggcataaaagctaaattgcctaaatatggctaactcttggataatgctggttaattctggctaatgtttaattctctaaagcatcttttcccatcaataaacttttttgtgggaactctcatttgccttgtgtttcttatggaaatgtgatttgtacatacatcctccttgcataaatatttagctcatcattgtgcagcacaaattccctgcaaattaggtggaaatcagcctcagctgacgaaagcatctatattcatccgggggaaaaatcattattatttagaacttattaagccctgacagtaagtactggatggacctgggaacttcaataaacattgaacgcaaatgtatgccaaatgcttgggcacagatttctcttgtaatttctacctgccaagaggcaggaaaaggtagagaaatgaaaatgggctgaaacttggctctgctcattacaaactgtttcaacaagagcaaatcactgaaaccctcttcatctataaaatgggtctaaccaaacgtatctcatagggtttgttattataaagattaaataagatcatatgtgtaaagtacctagcaagaagcccagaacacactagatgctcaataaatgtttgactctaaccaacaaatgaatctgaagtaggtgaaatgtagaaatgttagctcaccagttggttacagttgcatcctaccccctgcactgtgaacataatttgctccaattgcaactaggttttatttgaaggttgcagttaatgctgccaattttacataaaattaagtagaaaagcagttttgaaatagcttggaatagaaatttacatgttatataaattgcattattaaactttgcagccaacactcacaatgtcctgcccataccccttagacattttattgtgctccagggaattccacctgtcagcatctatatctctatgcctgagggctcttgttccaggaaccatgggaatctgccctgccagtgcatgataggtcagatgtgccaggtaaagaacactctcaggagccaccttcaaccaatgactaagggagccggtatataaatacccagttccctcacctcttgtgtgggatcagtctgaggcctaagtcttgcaccatttcctcaagttccctcacaggattaaaccatcatgattgatggctcaatgacacactttgctggcatcttgtcttccttgtttcacttcccaatctgtgtgaccttgaagggtttcagagtatactatcccaaaatatgccactctggcataaggattattttgagctgaaggcaattgagaataaggagacaccggacaagctctctacccttccctatctgcctgaaagcagaacttaaattcctcttgtgaaggtgtttccccgactcacataccaggaaagagataacaaccttatcaccagaaatgagatgatgaagccatctacacaaagaaaccttactaaccagcccttttctaccactaattttcccatatatttaccttcccacaatttgctgcccctagcagttcaaagtcattttcttttttcttgtcacttctctacaaaattattgttctttgttaagatggtatataaacccaagctctaaccattgctttgagttactcatcactaagttctctcatgtatatgtacactgcatgtgttaataaacttggttcttttcctgttaatctgtcttctgtcagtctaatttgcaggcccccagccagaagggtacagggaaaaaaaaaaaaaaaacttttcctcccctacaacctctacttcccaaataaatatctttcacttggattcttgtcttagcatttgggagaacacaaattaagcatgtgctgggttcagagctccagcctcatatacccaacagcacactggacactccactggctctttaattcaatatgaaaaagtgatctccccataggccacacacacacctgctccaaccccagagacagatccaccacccactcattcttccaagccagaaacctggatctcaccctcgctttttccttttctctcccctgctccccaccatttccagccatttatcaagtcctgccagtttgaactccataatctctcctggaatcagtccctttctccattcctctaaatactgaggcaaacaatctctggcttccattgcagtagcctcctccctgttgtcccagatccaccatggatcttttctccatgccacagtccagaaggattgttctttttaactgcaaatactgaatagcaaaaacaacgcttaatgaaagcttactttttgttgggccctgctctgatcctgttactccccagcttaaaatcttccatgggcttcctatagtgcttagaataaaacctccaactccttgcttgagcctacaagcccctgtgatctgatgccccttttctccataacttcttttcttaccatttccggtgctgaatctaatccgaagaggtccttttttgaaacaattaggtgggtcagttttttacttttccatggagaatcgacttttttttttctttttttgagaccagtctcactctgacacccagattggagtgcagtggtgtgatctcggctcactgcaacccctgcctcccagactcaagtgatcctcccacctcagcctctcaagtagctgagacgacagacacatgccaccatgcccagctaatttttttgcatttttgctaaagaaaggtttcaccatgttgcccaggctggtcttgaactcgtaagctcaagcaaaccacccatcttggtctcccaaagtgctgggattacaagtgtgagccaccacacccagcctgagaactgacttttgaatgtccatcaataccaactcccgatccctaccctcactcctacccatcatcttcccaggccctgctctatccatagcctccactttcaggaacaagcctttcctccctgagatcctcgctgaggcacctgggaagacatgagattatcctctttaacaatccataggttctttagagccagaacccgcccctaccttctgcaaggcctggcacagggcccaacacacagtaggtgcttaatgaatgtttgttgagttaattaaggaagctgtccagtcttaatcacaaacattcgggatgcttccttcaaaccaccttcccccaagggagcctatagttgattggacaattactccagtgctggaacaaatcactctcaggcgttcgatgaaactattcaatgaatgctgctgacaaaagagctgattgcgctgctttgaccctgaaagtaattacatgtgccagcatccatctgcctgtggggttgcccggaagggggtcctcacctcgtttcagctccatcttctaaataaactcaaaagagcatacattgtcatttcccccaggatcgttatggcttgttagaaatcaaacagagggcaggtaagtggtgtataatctgcatgaacaatctccccaggctccaaaaacctcccttaatcatctctatcacaaaaccaaaaccaaagagccccccactccttgagaacgcagcagggagcctccatgccccactaagggcccaggatcaagtgactgtttgctctgcggtcagtcccacacatcagccatctctggcctgttaattaccttctttcacccatcctgagaagccagagtcatccttgatgcttctatctcttcatctatccattcatttattcattctttccataagcatttattgaatacctgttagaaggcagcagacactgctgtgtttacactaatgaacaaggcagcataatccctgacctcatggagctcatagtctagagaggaaaatgaatattaaccaaacaaagacacaaatattgaagacaaatttacattaaacacacctgttatttgctgaatctttgccaggtcctgcaggggaggaatgtagcatgggaggggaggtcattgaccaagatggttttaacttcccctcagtttcactaaactttaaacaggtttctttctgactttgaggtcctggcaaacattttcttagagcatttacttttttctttttttctgagacacagtctcactcggttgcccaggctggagtgcagtgtcgcgatctcagctcactgcaacctctgcctcctgggttcaagcgattctcccgcctcagcctcccaagtagctgggatcacaggtgcacaccaccatgctcagctaagttttgtattttttagtaaagcttgggtttcaccatgttggccaaggtgatctcaaactcctgacctcaggtgatccgcccgcctctgcctcccaaacggctgagattgcaggtgccattttctctaaaacatttaccttaaaagatttgcagtctacagtttttttgttttgtttttgataaaaattgccccttttgagatgtaaatctcccagtttcttgccaatttttacaacctaggaatgtctttctcaaggatctggcagttatccctttgaaatgcaatcatcaagaaagatagcaccacaatctctcagtctctgcaggagggaaggtgcctaactttggtaagcaccaacattagcaaacgcaaatgtcctccaggactttcccactagctcaccccagtgcttaaaaaccctctttgctttggcctggcgcagtggctcacgcctgtaatcccagcactttgaggggccgaggtggggtggatcacaaggtcaggagatcgatatcatcctggctaacacggtgaaaccccgtctctactaaaaatacaaaaaattagccgggcatggtggcgggtggctgtagtcccagctactcaggaggctgaggcaggagaatggcgtgaacccaggaggcagagcttgcagtgagccaagattgcgccactgcactccagcctgggtgacagagcaagactccatctcaaaaaacacaacaaaaatcaaaacaaaacaaaaaaacaccatcctgggttttgtttcggggaggtaagttcaatctccctcccctactgcaattgtcttaaatagtctttctcgcctgattaactctgtccagtacagcaatgaataaaacacggatcctgccccaaaagaatgtaaggtctgatcaagacaaatgaaaactttccgaattgtagtaaatgctgtaatcccagcactttgggggatcaaggcgggcagatcacttgaggtcaggagtttgaaaccagcctggccaacatggtgaaaccctgtcactactaaaaatacaaaaattagctgggtgtggtgacacgtgcctgtaatctcagctactctggaggctgaggcaggagaattgctagaactcgggaggtggaggttgcagtgagtcaagatcgcgtcactgcattccagcctggggtgacagagcaagagtccatctaaaaaaaagaaaaaaagaaaaagaaaactagaggaagctatgagacagtgtaacagaggaaacttaatttagatgggaagggactctaggaaggcctctctgagaagaggtatttgagctgggacaagcatcccaggcagagaggctaacacacataaaggcatttagatcaaacattcagctgcagaaatagaggtatttgagctgggacaagcatcccaggcagggaggctagcacacataaaggtgtttagatcaaacattcagctgcagaaatgttaggtccctgccccaaaccaagtcttactatatttgtacatgcgactcttcttctactgtgtgctccctcagctcaataaccttccaggaatcccaggtggctcctgaacaaagcccattgctcctaacttccttaacctgatggtcaagattgtatttaatctgactgcttcttcacctctccagccatatagagacaacctcccaatgaaacacaagccttctgggtgtgacagacgaaggggcttcttgcagaggcaaatggaagacaacctagaaggtacaggtgcaaagtgctcacatgattgagagtctatttttatgcttgaagtacagataggagggaaaacagttctctcctattggacgaaaaaatccagttatttttccttattctgtgacacaaggaccttaagtaacctgaagtaaccaaaagatcaggctttggtgagtttatttcccaagtaaaagacatgcctggtgcttgacagtctcctgggacctcactagccctggagccccttccgtccccaacacacccattcccctctcccactctggaccaatccctacagttcccccagctcctccccatgcttctgatagggaaagagaatcagggtcacccttatgttaagaatagaagtaaaatcttgatggtattacatttggacaccccacaatgcctgattcctggctctctgcaggattccttagggagccttcatcatagaggtgtcatcaagcaggaaacaccatgttcttctgtgatgagctgggcccaagcctggtccacacagtacagaactcaaaagacccgaggcaggagcacagagcttgaactcaccgctgttatgcgttctacctccattaaagctccagtagcaatgcagcagcagggagggcatgctggcctgacagcacgtccccaggaaggggagtctacacgtgtgtatgcaactgcacagcccactgtggccttgcccacaggtccctgtgatccaatcactgtcctggcctttgaacaatcagatggtcagagggattggagcacctgaaggaagtgagagcacctccccatcacctctgatcactcttttccaactctctctgcctgctagccctgagcgcaggattgtctgtttgaccttctcccaagtgtctgggtcatgctctccatcccaaagctaaagcccttgtctccttcaccctaatcaccctcctttcttcaccccttggcccatggcctacgtagggcttcgagctctgggcggtggttcacacactctgctcctaccctctctgggtcaggagcttcctaaagccaggcctgcagcccagcaatccccttgtccttgactcgtgcatctgggatgagctctatctgcatcccgtcaagagctctatctgcatcccgtcaagagcaaagagttactgaggagatagaagcaggactttttttcctttaactcaattaagccacatgctgactgtgatactttctccactatctaaggcagcaggtgcctttgcaattacttcccctctgctgagcctgcatgtcgcctggggtctccaggagatagagatgaagctatggaatcacaagggcaatgtgatgggcaaagaggccagggagaccagaggactggccacagagaaagatcagccaggaatgcaacaatgcaggtggccccaggcaaagctacatctggaagccagctgacatgtgactttcagctgctttcaagggccttagaagcaagggagcatttttaaatttgggttcccccaaaagcagatccggagacaaggactgggtgcaggtagtctatttggaaagtgagcccaggaagcagtgaaggagaactgatagggagtgaagaaagtcgacaaagcctgcagctacgagagggtctgttgctgtgggctgatggggctcaatcccacttggaactccatggaagactgtgtggagcatacatgagaagcgttcccaaggggcaaaaaagccaagtgtttactcaccatacagggttgaatggtggcccccaaagagacatgtccatgtcctaacccctagaacctgtggatgtgcccttatttggaaaaagggtctttgtgagtaaacttaaagatcttgagatgagatcaacctggattacccagctgagccgtaaatccaatgacaagtgtccttttaagagatacatacagggtcaggcacagtggctcacgcctgtcatcccaacactttgggaggccaacaggggtggattacttgaggtcaggagttcgagaccagcctggccaacatgatgaaacccccatctccatctctactaaaaatacaaaaattagccagcgtggtggcacacacctgtaatcccagctactcaggtggctgaggcaggagaatcttttgaacgcaggaggcagaggctgcagtgagccaagatcatgccattgcactcctgcctgggcaacagagtgagactccgtctcaaaaaataataaataaataaataaataaataaataaataaataaataaagggagagagagacatagaaaaggaaaaggccatgtgaaattagaggtaaagagtgcagtgatgcaaccacaagccaaagaatgccaagagccagcaggagctggaagaggcatggaaggattctccttagagccttccaggaatcacatgaccctaccaacaccttgatttcagccttttggccttgagaactgagaaaacaaatttttaagccacaaagtttgtgataatttgttgcagcagccacaggcctggtgttatcgatgggataacacccatcgatacccaaaccttcctggttaagaattactcctggggttggccgggcacagtggctcacgcctgtaatcccagcactgtgggaggccgaggcaggcagatcatgaggtcaagagatcgagcccatctggccaacatggtgaaaccccatctctactaaaaatacaaaaattagctgggcgtggtggcgcaggtacttgggaggctgaggcaggagaatcacttgaacccgggaggcagaggttgcagtgagctgagacgcaccactgcactccagcctgatgacagagtgagactcagtcttaaaaaaaaaaaaaattactcctggggtcgtctgtgccactgaaagctgaggccactactgcagccagagaaagacctccggcagagagacacctgtgcctacagtatgaaaccaccagcgtgaccaggaactgcccacagaaactgcagggaacctctgggaagaagaggctgaaggatgtggaagggtgggggagtactgacagcgcctgccacagtttggctggaattggatcagggccgcttctggtccacgtgactgtgttttctaaggggacctccatcaggaatcaagctcttcctcaggatcataccgtcacgtagggaaaaaaatttacattaccatgttcccactatgtgcccacacacacatcttctcccatccatcctttaaacagccctgtgagatacgaaggatatgacaggcagaataataacccccaaagatgcccatgtcctaatccccagaacctgtaaatgagctaccttgtatggcaaaggggactttgtagatgtgattaagttaaggatcttgagatgggggattatcctggattgcccagatgggcccagtgtaacatagggtccttataagagaaagggggaggtgggagggtaggggatccaaatcagagatatttgaagatgctgtcctgcaggctctggagatagggaaaggggctatgagccaaggaatgcagatggcctccagaagatgaaaatgcaagagaaagcattctccccctagagtctccagaaggaatgcagccctgaagacacctcgatttttgcccagggagacccatttcagacttctcacctccagaactgtcatattacacatttgcatgttttaagccactgagtttgtcgtcatttgttacagcagcaataggaaactaatacattttacaagggccttagaagcaaggggttgtgttttaatttggcttccccaaaaagcagattgagagataaggacttgggtgcaggcagtctatttgggaggtgatcccagaaagcacagggaaggagaagtgacggggagtgacaagagtcaacaaagcctacagtaatgagagggtctgttgctgtgggccactggggctcaatcccacttggaactctctggaagactgtgtggggcagattgagtttagtctacgagctgcgaggaatgggatgggagctattagcagaagcttctctggatttaagtttctttcccatggtacaggatagtgtttcttagagagtaattgattctttctttttcctctttccttttgctttcttttttgcactcttgctttctccatgatctcctccaaccccaattcaagctgccaagcctcttgagctcattgcctgagagaagaggacagacatgacctggggggacaacagaaacacagccgcctacctggtttaccatcaccacagggctttgcccttggggaatgcaaaaacctgcaagaggaatatggccatcctggccttccccaccccaccagccaggactggtgaattttcccccaggactgagaaggagaactgaagatctcccgtgagaaagggtgtgcaccccagggaagcagcaagagcccagaaaggagagactgaatgaggagaccaggcaggcggggctaaagaactgacccggcttggcccttcacataggatgctgtgtttaaggctgaacaagccagagtttggagaacacgccgtgcgccatcatgactgttgcccgagctgaggccagacccaaccccgaggaagggagaacagcttcccatgaagggcatggctgctgccaccataatcccagggcaggaaataaagggatcttggactaggcaatcaaaggacttcctctccctctaaggccaaggaggaaatgtggctgggactccaagctctgtggatgcctggaggtgccagcagctggggatcagctggccccacctgcagagcccagccagtggctccccctgcatctccaaggttgggtctatgggctccaagaacaggtgtttctcagggtaacctcagcccctacaacttcaaccaagagagtgaaggggagcagccctggaggccaatgaggagggggattagtggtcactgatgacaaagacatccctgtccccagagccagccccttgtgagcagaagaatggctgccggggcaaaaggacctgctatgccctccccatacacatatcatggcagctggggagccctctgaataacagggggcgctttagagtggcttcattaccaacaagaggcccagaaggggctagagccacacgatttcatggtcggccgcgtgcgtgatcgtgtctcacagcactggagaggcttccagattacacttgtaataaaacattttatggggaagaaacaaatgggagtaaatttgaatgcagaaataagcaatgttttagagttttgtatcattagcagaattagataattaaaaacataaaccagaaataataagccctccctctctgggacaccctgtgtattcaaggagatgctgtgcgtacaggacccgtcagagccagcagagcagacagtgaatagatctacacaagaaaggatcattcttaacatccctccccaacactacacagcaagattatcttctgtaataattatggaataatcagtaataatcattacgttcctgattcattctttagtcttaaaacaattagcaattttagaagagaaatttcaatgttacatatattattcagattcaggaaaatatttactggaggaactaaaatttgcactcaccaaacaaaaaaaatattccagctcaatggccggacgcagtggctcacacttgtaaccccagcactctgggaggctgaggcagccgatcacctgaggtcaggagttcgagaccatcctggccaacatggcgaaaccccacctctactaaaaaatacaaaaattatctgggcaagataatcccagcttgtaatcccagctattcatgaggctgaggctgcagaatcacttgaacctgggaggcagaggttgcagtgagccaagatcacaccactgcactccagcctgggtgacagagtgagactctgtctcaaaaaaataaaaataaaataaaacattctagcttatggttcaggctccatctcatggttcgaaattttcagctccagtaaaaactccaagtggtcatatagactttaattaaagaattaaaataactcacattagattttgtcatcatttaattagtggactattatggctgatattggatcaactgtttatttttattttatttttttgagacaaggtctcactctctgttgcccaggctggagtgcagtggcgcaatctccagaagctaatgtaacatatgtggaagcattttgtaaactgtaagtgcagtacaaatattactagagttaacagtaataactgtgcagatgcaatgcatttggtcacaataatggaccagaaaaatcagagagaaaaaggaaggtagttgtttatgcgggtgttaacaacctggacaaaatgccacagccaaattcaacagcaccaatattatgttaccaaaatggagcctgtgaagacagccaaatggggtgaccacacctcccagtgccaggcagccagctgccagagacacatttcagctcagtcatgctgaggcaactgtgccattgcagagaaatggccatgatattcaccagcccctggaaacccagcagcccccaaacacttccccagagctagcttataccaggttgttggcagaggacagaaatgagagagacaagcgaccacatggctgcccaaggaggtgcctgctgggacacaggcactaaatacgaggtgttctggaaaatccacgaccccctactccattgagggagacaaataaagagcataaagctgctctttgcaaaagcatatttagtgaacacatagaatttaggctagatgtttctatttttttctcttgttttctttcatttacaaaagaaacacatggcccctaaagccactcttctctgcctactcatgagtaatgggtagagggagagttatttagctggaatgaggtacaaagagaggctgacacaacgagaacaagagttagaggccacagactcctcacagctgacctggggagcatcctgacaaccctggaagggacccctcctggaaggtcacacaagccacccttccatccagcactagagtggccttgtagcctctgctttgcatgcctcccaggacaggacagtcactgctgctggaaacagctgtggacatctctgatggtgaaaaaggtggactgttggccaagcccttcacactgcccatgtctccatattcaagccacagctgtggctgggaatgccttgcagaagcaccatgcaacccatcctccccaaatgaaattgagcccccgatgtggtccctgcccttgtttacagcatgcacagctgtctgtgttttagcctattttattactcttcctcacccccacttaactgtgagctctttgaagacacaaacagttttctccttgatgcctgatcaaaatagatacttcaaaatccttttgttaaaaacgcaattctaggccgggtgcggtggctcatacctgtaatcccagcaccttgggaggccgaggtgggtggatcacaaggtcaggagatcgagaccatcctggctaacacggtaaaaccccatctctactaaaaatacaaaaaattagccgggcgtggtggcgggcgcctgtagtcccagctactcaggaggctgaggcaggagaatggcccgaacccgggaggcggagcttgcagtgagccaagatcgcaccactgcactccaccttgggcgacagagcgagacttagtcaaaaaaaaaaaacaaaaaaaaaaaaacgcaattctagccgggcgcggtggctcatgcctgtaatcccagcactttgggaggccgaggtggacggatcacaaggtcaggagatcgatatcatcctggctaacatggtgaaatcctgtctgtactaaaaatacaaaaaattagccaggcgtggtggcgggtgcctgtagtcccagctactcgggaggctgaggcaggagaatggcgtgaacccgggaggtggagttttcagtgagccgagattgcgccgttgcactccagcctgggcaacacagtgagactccatctcaaaaaaaaaaaaaacgcaattctataacatcattacccaagctccctctgccctccagcttctgggctaggcacaacctcacagagcatcagccacctggcccctctcatgccctcaccccaactgcaattcccagcttcactccacccctagagaaactaagctcaaagcaatggctttaggatctcagggcagctttctaatccaatcctctgttgctgtggttctcaaacttgatgtatcaggatactctgaaagacttaagacacagatttttggacccaccctccaagtttctaattcagtgggtctgaggtaggtcttaagagtttgcacttctaatacattcgctggcgatgctaatgttgctggtccagggctcatattttgagaaccacggtaccacagtgctacattgaggtcagtccttgaaagacattcccagccacaggaacagcttgagtggaggcagaggcagcatagaggcttgggtgacatctgccttttctcaccattcaagatgtctgcaagctgctttaagcagcattgagcacccaaggcacacgagcagaggctaccagaccatatcacacacgcacagcttctctgctcacggtttatctaacctctgtttatacatctctgtcttagtccatcttttgtgagcgttgctataaagaaatacctgaggctgggtaatgcataaagaaataaagttagtttggctcacagttctgcaggctgtacaagaagcatggcgccaacaatctgcttggcttctggtgagggcttcgggctgcgtccactcgtggtagaaggcaaaggagatctggtgtgtgcagagaatacatggccagagagagggagcaagggagaaggtgccgggctcttttcaacagccagctctcattggaactaatagagcaagaacacactcaccacagcccccagggaaatcattagtctatccatgagggatctgcccccatgacctgaacacctcccattaggccccacctccaatactgggggtcaaattacaacatggaacttagaaggaacaaatatccaaaccatagcaaccttcttcaacaagatattcacaacttgtccagttagactggccaatcttcagttatttcttatattgagtgactgctcacctcctgcctagggttgccagataaaacacaagatgcctagttaaatttgaatctcacatcaataatggataattttttggtatgtctcatgcaaatatggttattttcatttgctaaacctggcaacccaacattcctacccatgaagtctccaggtgcttgagccaagttcctgccaatactgaagcagccaggtgagcctcaagttcagaggaagctaggtcttctgcatcacagaaccaatttagccaaagccaagagcaaaaagagtcagtctcaggaaacacactttgttagagctgcactaagctcaggtcttacagctagtccagggctggggctgtggcaagaaaatgacttccacttgggcttcccaggtgtgggggtccttgccttgaagcagatttgcgctggaatcctatcatatggtcaatacctggtcatccatccatacccacaccataggggaatgttagagccagggctaaaacccacttcttctgattcctgtgctaacaagttttctctaatgcaagaatcatttcctaagaggtaaccccaggatcctagtataggtgctaagtggtggaggaatctttctgcacaaaccttgtcattgcaaactccaaactctacgggtcagaagagtcctgctcacttcacgttgtaccccttagatgccatctggcccagccacctcataggagaccagagaggtgaaagggcttgcccaatctccaatccaagttgacagcagagctggacaaaaatctacatctactgacagctcagaccttgtccaccctgccaggatctcttccaattaaaaggaactactgttaacttaaaaccacagagatgtaccatttttctcccacggaactagcaacaatgaaaaattctgacaatatcaagtgttggagaagaggtggagaaaactgtattctcctctactgctggtgggaatggaaatcacaagggcaaacttgcagagcattcagcaatacctagtaaaatgggaagtgcatatatacaatgtaacaattccactccagcttcaggcccccacagcaactctcccacatgagcccagtgagatctagggcaaggatgctgacggcagcattatttgttatggtgaaaaattagaaacaaactacgcaacaagacagaaatgagaaacaaaatgtggtctattcacatgatagaacaccttgcatagttactaggttggtgggaaaggaattgccatttttgccattgaaagtaatgccattgaaagtaatggcaaaaatggcaattccttttgcaccaacctaatagaaagaatggattagagctaaatgtatcactaacaacagtgggtgaaagtgtccttatgtgaaaaaccaagctgcaaagagaccagagcaaatttgtgtaaatgtggaaaagcacccccacaaacaataccatacatttattattcataatacattacatatgtatacacaaaatacaaaagcttcccaaaaaaaagtatttttaaaaggcacagttattcatgaaagtcatgatagtggttggctctggaaagggacaaagattaaaccttaagggtgcccctcaaggggtgcttcaatgtcttctgtaatgttttatctcttttattaaaaatatacttgaagaaaatataacaaaaggttcatagttatcatcccagtggtggggatgcaaatttgttacttttgtatttttcttttaacttctcaaagaaaaataaagcggctattctgaggcactgatctctggggcccccagaacctacatgactaatgaaatgtgtttctcggatttcaataattcatcgcctgagcaggggcgtgggtgtgggaaaagttccatccttaagggagtgcggaagaatgtatccaatcaggctaaaatctcccttcctccatcctgactagaaatgaccttgggtctgactggaaaggtagagggtttaatgcaccggatgcttctccccatctattttagaaaggtggaaaggaactcacctagttcaataattcatcagaacctaagcatgatgggatggagaaccttccagagtcatgggctgtgagtccagcaacaaccctccatgaccactcactggctggtttaaggtgaaggactcatcccgagggtggtaagagacataatcccatcggtgcaagaggcaaaacctaaatgcacgcacaaaccacatgtggatcctgctgaaatgctaatcctgagtgagtaggtctgggagagggaaggcaggcaggggtagggggagtgctgagatgtcacttttctgtcaggatcacagggtggggcgtggtggctcatgcttgtaatcccagcactttgggaggccgaggcggggcatcacttgaggtcaggggtttatgacaccagcctgaccaacatggcgaaaccccatctctactaaaaatacaaaaattagccgggagagatggtgggcactgtaatcccagctactgggaaggctgatgtgagagaatggcttgaacccgggaggcggagcttgcagtgagccaagatcacaccactgcactccagcctgggcaacagagtgagatttcatctcaaaaaaaaaaaaaaaaaaaatcacagatgtccctgatgcttctgctccaaggcccacactttgagtggcaagtctctacactgcccacttcaactgctgctgcttggtctttctgcttcattatcctacaaataaaagcaggagtgttggtggtatttgatggtattagggtcaggagaagcagaaacactaactccaatctcaaaggagacagtaaaaatatttacaacttgatcacagaggtgtgcacaaatgtcaaatctcatcacacttaaaatctctgcattttattgtatgtaaataccaccttagcaaaaaaatatcctgaaacaaaacaaatcaagcctggtccaccaactccctctgaaggctaacctagatcttggcatcttgttacccactgattgggctggagtaaacagtccctagtgacccacccaaccgtagggaagaagaaatggaacccgaatatccaacctgggtgcactccctttatacacatcgcagccacatccgctagtgaacatgcccccactgcagggccttggatttgccccacttagtaaactcttccttctttgcagggggaaacctagaactcaggtgggcagaggggtgcttttcttctcccctcaacagaggtcatcttaaaagggcagagtagctactgagagagaggctgtgtggccaagggaagtgtcaccaaacctgtccttgttaacgtcccttttctgcctttcgagtggctccagcccttcccgtgctgagcttagcctctgtttcccctctgggaatcatcccacctagaatataagttaacttgaatactaggctgtctctcccagcttttttattttcttttttcttttttgagatggggtctcactctgtcacccaggctgacatgcagttgcatgatctcggctcactgcaacctctgcttcccaggttcaagcaattctcacgcctcagcctcccaagaagctgggatataggcgtgcatcaccacacctggctaatttttgtatttttagtagaaatggggtttcaccacattgccccggctggtcccaaacccctgacctgaggtgatctgcccgcctcagcctcccaaattgctgggattagaccacaggttaatttcaatacaaggctgtctctcccagctctgattcctctctggtcccttgttccccagtactctgcaaccagtggcttgcaaaccttattgcgcaacacaatttgctggaaaacctgtcagagctgtgtcccaccccaagtttctgattcaggaggcttgagtggagcctgagaatctgcatttctaacaagttcccaggtgacactgctgctgctggccccagggatgtgctttgaaaaccatcacgttagactttcaacaaacatttgctaaatggatcaaggaacagaactacaagtagagtcagttcagagctcctgtcttggttctggagctcgctcagagatcaactttttaagtaaagctttcttcctaagacacagcatactcattttttaaaacaaggataataatgccaaccccacagggttatagtagggatccagggaagtctttctgagaacctattagaacccacctctgcctagaagccctccaaatccatgaccctcccaaaatccatgagggtttagttccctctggaatcctccagccataaccgctggaagaacacttagatgcaaactaccttctatgggagggtatatacattccccctaaacacatctgtgttcggaccttgtgctacatcccagagcttccgaggtggggaagacagtcattcccaggctggtggggagacagatatgggaagatgcatttgatacacacaatggttatcaatgcaggaacaaagaacagagctcagagtcaccaactctcctgaagaggattccggaaaggcttcctgtaggtggtgatgcatgagccaaggactgaaggatgagcaggagtctgtcaagagcacaagacaccctgcttccttgagtggcccataattgattcagcttgggaacttgactggccctgtcctttcgagctcagatccatgcacacaccacgtgctcaaaaatgtgtcatcatttgtccaggcatggtggctcacacctataatctcagcactttgggaggccgaggtgggtcacttgaggtcaggagtttgagaccagcctggccaacatggcgaaaacccatttctactaaaaatacaaaaattagccaggtatggtggcaggtgcctgtagtcccagctattcaggaggctgaggcaggagaatcacttgaacctgggaggcagaggttgcagtgagccgagatcatgccactgcactccagcctgggtgacagagtgagactccgtctcaggaaaaaaaaaaaaaatcatcattggattaacagacccagcttcttcattgcctcccaggaatgatgccttgtctgacccatggcctgagaaaccaaaaaaaaaaaaaagaccattcaatagattgccctactctgatgaataagacctacgtttgttgagacagcaaagcaggaaatcctttcctatgtgcaaatggtgcagtctcccattaaagcaaaggcaaaggggatgaggctcccctattcacgttgaggctttgcctctagttcagccaccatctggctgccacctgtccctttaggccacctgaaccattggtccacagtcatcagttccctgaagcctgggatcccaaacagctcttacactgtctcagaaaacaaaacaaaacaaaaccaaaaaactcataaacccttctccagcacccagttcctgaagaaagccaggggccagggagacaggagggagagagaatcttttctgcaatcaggcagattgacctgagtttaaatcctagcagtaccttgtataagccacgtgacctgaggccagttattcacccactgggtctcagcttccacatctatgaaatgagcataaaactgctcacttctcaagagtgtggcgatgattaaacgagggcaggtgagtggagagcccggctcccaggtgtacagcccatgggatttggcggcacagagggacccacatgtggagagacgatgttggctggacagcactcctcctggcttccatcccccgcccttgtgcagagcgcgggaagtaggagtgtgaaggcctgagtcctctctgcagttctcttggtgactcagcctcgggcagtaagctcagaaataccacgcgcccagcctgttctggtgacatttcaaatacagagcgtctctcacatcccctcccaggctgtctggtcagtatccattactccagaactggggcgggttgtgcatttctatttccttttcaagggtccttcttcccatctcacccggagatagcacttacagttgatggagtgctgtcctatggctaactttatttaatcctcccagcaaccttgccgaagaggaaactaacactccaaggggccaaaccaactgcacaagatcacccagctggtcagtggcagagccgggatttgaactcagaacttcctggctcacctgcctcgctttttgcactcacccatttaccatgcaaacagggacaaagtgaggccacggttccctcggccttcggacccactctcagcgtcaaacaagagctgggccagacagggggaaatgcactggaactctctggcacctacctgaccaccctcagacaggcagcagtgcagcccagctggtggggccaggtcctcatccacaggcaaggcagaacctccccaaagattctgactgccagctgggcctccatttcggcctctggtcacgggccaatccttcatagggtgtaaccaactggaggcctgtgaagggcacctaggggtgttgccggcttcttcctagcttaataaaaatcctaattgaggaggctcttaagccacttgctcaagcccactcccactctgaattgtcttcaataaatctgtgctttcgttactgtttttccgttgcttttcattgcctcattcgttactttgtgcattgtgttgaattctttgttcaacctgctaagaacctggacaaccctctccggtataaaagcttcctacagagcctccccagacagagcctgacctcagcaccaggggctgcctacagtacagctcctctggtcactgtccctcctcatcccaccaggtgtccctcaggactaattgacagacacacctggctttgcacctcagccagacctctagcatgaaggagatacccgaggggccaagaactgaatctacacactgtccttgcctcccagctttccccagcctgactcaccatccaccaccctttccctcccagacctcttccctgtgttctttggaaacacttttaaattttaattaattttttttttttttgagacggagtctcactctgtcacccaggctggagtgcagtggcgcgacttcagctcactgcaacctctgcctcccaggttcaaacgattctcctgcctcagcctcctgagtagctgggattacagacatgtgccaccacacctggctaatttttgtatttttagtagagagagggtttcaccatgttgctcaggctgaactcccgacctcaggtggtccaccggcctcagcctcccagagtgctgggattacaggcgtgaggcaccacacccggcctggaacccatcttttaagtgaacaaactcacccccatgcttcaccacgtccccagacaaagcatctgtaccttctgtctcaactgaaggtctctgcccccaccaaaaccccacttcttatgcagcctcattcagccggaactactcctctctgcaccccctacctcaaccctctataagcacgtaccttaaggtccaaatttgcagtaagcatcctctttgctcctcactgctaactgggcctggcttccttgcctcaggtgaaactagctcttcaagcctgcgtctcccatcctcatccccatccttcttcctgaagagcctccctctaccccaggctctgtccctttctccaccctaagcaagccctggcagcttctagggccgggattctccaccttgcctctactgacattgtgagccagctcattcctgtggtgggggctgttctgtgccctggaggatgcctagcagcatccctggcctctactcacaagatgccagcaacactacacacacccctcagtcgcgaccaccaaaaatgtctccagaccttgtccaatgtcctacaggggtacaaagtcacccttggtagagagtcactggtctggagcaacatcagcatcctctggaccccaagtccagtgcctttgacctcccgaccccagcgacagtcacttcactcggctccagccctctcccggtgcagccctctgccttctccacgccccaggctgccaggaagcagatgaaagagtgaaaccgcatccatgcagactaggcttcggggccaagctttaacccactccactcggccttcagccagtctgacaccttcatagcactacccccaatctgtaattgaattgtaattttttacgattcaattaccacttccttctgcccgttgtcttttctgcctcctccactgggctataaattccatgagggcaggaactttactgatttcttcatggttttattccttacactagtgaaaggtctggcacagaagacatttatggagagagggaagaaagagagaaaggaaggaagggaaaaaagaaggaaagacagaaagaagggagaaaagaaaaattttttggaggaaagaaaactttgtagaagaggagaggtattaatcagatgaagcaacaacaagagtcaagcataacacgcatgtcacggaataacccgcagctaatgaaagggacagtgtacaagtatctctagagtcactgacatgcaaatattcctaataacactgactatatgctcatctgcatttatacccaaagaaatatctaaaagcatgcccaccaaatggtcaaagatttttgtctctggtaaaagtgagatttcttttttacttccatttcctacaatcagcatgtattacctttccaaacttaaaatagctaccattcacccagcaatcccattactgggtatatacccaaaggaaaataaatcattctaacaaaaagacacatgcactcctatgttcattgctgtattattcacaatagcaaagacaggcaatcaacctagatgtccatcaatgatagactggataaagaaaatgtggtacatatataccatggaatacagccataaaaaagcatgaaatcatgtcctttgcagcaacgtggatgcagttggaggccataatcctaagcaacttaacgcaaaacagaaaaccaaataccacatgttctcacttgtaagtgaaagtgaagcattgagcacacatggacataaatatgggaataataagacactggggactaccagagggaggaaggagtggggcttgggtttaaaaaactacctatcagatactatgctcactacctggatgagaggatctgtaccctaaacctcagcatcatacaatattcccatgtaaccaacctgtacatgtaccccctgcatctaaaagttgaattttttttttctttttgagatggagtctcgctctgtcacctaggctggagtgcagtggctcaatctcagctcactgcaacctccgcctccctggtttcaagcgtttctcctgtatcagccacccgagtagctgggattacaggcacccatcagcacacccagctgatttttgtatttttcgtagagatggggtttcaccatgtcggccaggctggtgtcgaactcctgacctcaagtgatcctcctgcctcaggctcccaaagtgctggaattacaggcgtgagccactgcgcttgacctaaaagttgaaatttttatagttgcactaaaatagtccaggatgtgtttgacggccttctactttgcccatttagcttctgcaagctcttgtttagcagggaacagttatctcttaacacatggttaaatctctaagttgatcataaatctctcattttcaaaaaaaaaaaaaaagtccttctaaacaaaaatttataaatcatgtttttgaagaatatattttaagatgggaaaattctcactataaaaaattaggtgaaaagtgagatacacaaagaaggtgcatattatacataatacatatcacaattaaagcaatattttagattttatgtggaaagtgctaaaaagaccagaaagaaatccagcccatgtcaacaacagcagttctgaggggtggaggggcagggatgagatcactttgccatttctcttctatacttgtctttattttccaaatcttctagagcaggggtccccaacccctgggtgacagactggtaccggtccatggcctgttaggaactggactgcacagcagttgagagagagcattactgcctgagctccgcctcctgtcagctcagtgctggcattagattctcagaggagcgtgaaccctactgtgaactgtgcatgcgagggatctaggttgcaagctcgttaggagaatctaactaatgcctgatgatctaaggtggaacagttccatcctaacttgctcacccctaccccacccatccgtggaaatattgtcttccacaaaactggttcctggtgccaaaaatgttggggacccctggtctaggtcagcaccatccaattttgcagtaagtagccacaagcctcccacagctatagacacttgaaatgttagcaaataggaccaaggacctgaaatttttattttactttatttaaatttaaatagcctcacatgcctagtggctactgtacttaagaataggaaactgaacaacctgctcctgaatgattactataacgaaatgaaggcagaaataaagatgttctttgaaaccaatgagaacaaagacacaacatacaagaatctctgggacacattcaaagcagagtgtagagggaaatttatagcactaaatgcccacaagagaaagcaggaaagatccaaaattgacaccccaacatcacaatgaaaagaactagaaaagcaagagcaaacacattcaaaagctagcagaaggcaagaaataactaaaatcagagcagaactgagggaaatagagacacaaaaaacccttcaaaaaattaatgaatccaggagctggtttttttaaaggatcaacaaaattgatagaccactagcagactaataaagaagaaaagagagaagaatcaaatagatgcaataaaaaatgataaaggggatatcaccaccaatcccacagaaatacaaactaccatcagagaatactacaaacacctctccgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccggatggattcacagccgaattctaccagaggtacaaggaggaactggtaccattccttctgaaactattccaaccaacagaaaagaagagaatcctccctaactcattctatgaggccagcatcatcctgataccaaagccgggcacagacacaaccaaaaaagagaattttagaccaatatccttgaggaacattgatgtaaaaatcctcaataaaatactggcaaaccaaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactttcaataagttagatattgatgggacatatctcaaaataataagagctatctatgacaaacccacagccaatatcatactgaatgggcaaaactggaagcattccctttgaaaactggcacaagacagggatgccatctctcaccactcctattcaacatagtgttggaagttccggccagggcaattgggcaggagaaggaaataaagggtattcaattaggaaaagaggaagtcaaactgtccctgtttgcagatgacatgattgtatatctagaaaaccccactgtctcagcccaaaatctccttaagctgataagcaacttcggcaaagtctcaggatacaaaatcaatgtacaaaaatcacaagcattcttgtacaccaataacagacaaacggagagccaaatcatgagtgaactcccattcacaattgcttcaaagagaataaaatacctaggcatccaacttacaagggacgtgaaggacctcgtcaaggagaactacaaaccactgctcaatgaaataaaagaggacacaaacaaatggaagaacattccatgctcatgggtaggaagaatcaatattgtgaaaatggccatactgcccaaggtaatttatagattcaatgccatccccatcaagttaccaatgactttcttcacagaattggaaaaaactactttaaagttcatatggaaccaaaaaagagcccgcattgccaagtcaatcctaagccaaaagaacaaagctggaggcatcatgctacctgacttcaaactgtactacaaggctacagtaaccaaaacagcatggtactggtaccaaaacagagatatagatcaatggaacagaacagagccctcagaaataatgccgcatatctacaactatctgatctttgacaaacctgacaaaaacaagaaatggggaaaggattccctatttcataaatggtgctgggaaaactggctagccatatatagaaagctgaaactgggtcccttccttacaccttatacaaaaattaatccaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcacagtgaacaggcaacctacaaaataggagaaaatttttgcaacctactcatctgacaaagggctaatatccagaatctacaatgaactcaaacaaatttacaagaaaaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggacgtggagaaataggaacacttttacactgttggtgggactgtaaagtagttcaaccattgtggaagtcagtgtggtgattccccagggatctagaactagaaatgccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcattattctcagtaaactatcgcaagaacaaaaaaccaaacactgcatattctcactcataggtgggaattgaacaatgagaacacatggacacaggaaggggaacatcacactctggggactgttgtggggtgtggggaggggggagggatagcattaggagatatacctaatgctaaatgacaagttaatgggtacagcacaccagcatggcacatgtatacatatgtaactaacctgcacattatgcacatgtaccctaaaacttaaagtataataataaaaaaaaaaacagatatgacataatcacaaaaaaagaaagaacagcacaccagagggaaggagtagtttttattttttattttttattttttttgagacagtctcgctctgtcacccaggctggagtgcagtggcacaatcttggctcactgcaacctctgtctcccaggttcaagcaatcctccttcctcagcctcccgagtagctgggattacaggcatgcaccaccacacccggctaatttttgtatttttagtagagatggggttttgccatattggccaggctgatctcaaactcctgacctcaggtgatctgcccgcctcagcctcccaaagtgctaggattataggcgtgagccaccacacccggccagtagttttatatacttaggaaaaaagtactagatgtgatttttaagttaataacaacttagaacagaaaatccaaacactgccccagtgtctggcccagttccagctcaatgctgcattctgcatctgtttattgtaagatgtgaatgccccatccaactttcttggcagatgtatccttttttacacttttttaaaaactgaaagatgatttcttcatttcttattcagttttgaaagggaggcacagtcaatgatctcgcacgtattccagaaactgacttccttagaccttaacagaagctactcaagtgcacagatgtttgctggttttacatggaggccttgctggctatgaaaaaacattcccctctaattttttgctcaatttgttttaagttggtaatgaaatctgtgaatctgtgttccctttctacaggaaaaatagaattttgatctcttttaaaaatcagaacgcaacaggataatggagaaatcagtctcaatagcacatttcttgttcgtttcagagcggtgatgtaaacacgatgatgctatgcttttggggtctttgaggtttctgccaaaagcatagcagcttaggtggattcgtgcctaccgcatgcttctttggtggatttctgtcgacaaattgtatgtctgctcttctgaaatagcatcatgaagttgttaatgtctttgcataaagaccaccccattctgtttgccctggggacaaagactttgcactaatcaccttgctctctcctggagcgaagagctgaagaggcaacaggaaatgcttatttactgagttcttactgggtaccaactgtggacacccacagaaggggtttgagtaagtatctcctcattgtccaggggccagagtagagaacagaaaggaaacagcttggcctctggttccacaaaataaataagaataaaatagaacattgaacatttgtgtttctttcaccatcttaatgtatgcactttgtagattctgcattcaaacatgtagaacaggctaatgaaagaaaatgccaaggccgggcacagtggctcacacctgtaatcccagcactttgagagtccgaggtgggtggatcacaaggtcaggagttcgagaccagcctggccaatgtagtgaaaccccgtctctactaaaaatacaaaaatcagccgggtatggtggcgggcgcctgtaatcccagttactcgggaggctgaggcaggagaatcacttgaatccgggaggcagaggttgcagtgagccgagattgcaccattgcactccagcctgggtggcagagagactccatctcaaaaaaaaaaaaaaagaaagaaagaaagaaagaaaatgccctcaaatctcaccacccagagacaaaatcattcacttttggagagcattcttccaaatctcgctctcttccaatggttctcagctgaggacaattttggccgcctgcgtacatttggcaatgtatggaaacatatttggttgtcacacactaggaaggggtgttcctggcatttagtgggtagaggctgaggatgccactaagcatcccacactgcaaaggacagcccctctctccaccacaaagaattatccagctcaaatgccagtggtgctgaggccaagaaaccctgctatagacatatggatgtgtagctctgtgataattacataatcaagttcatactatgccagctgctcatcatcctgcaagaaaacatgtatcgcttgtctgctatggtcaagcactgcctgttccttagagagggcctcatttaatttttaccagaactctccaagaggaggaattagtacagatgttacgaagagactgaggttcagagaggtgaagcgccttgaccaaggttgcacagccattagttgtggtgctaagaccccagtccaggtatgagggattccaaactgcctttcctaccgtctgtccatttgctccctttcaccgcaggacccagtttacaaggggcaattagaaacctaagagtaaggcccttgagctcccctttcagaacctgagggaagcattatttaaatcttctccatttttacatttgtcatattttatctgtgaagaataccttcaacttcctcactaatcacttttctgtccattgctcattgttttcctaccgtttaactatacatatgtgtatgctatactatactcataactattatatcttggttgtaggttaaaccctccattagtttgttaaataattttttttttttttgagatggagtttcactcttgttgcccaggctggagtgcaatggaatgatctcagctcactgcaacctccacctcccgggctcaagtgattctcctgcctcagcctcccgaggagctgggattacaggcatgcaccacctcgcccagctattttttgtatttttagtaaagacggggtttcaccatgttcaccaggctggtctcaaactcctgacctcaggtgatccgcccacctcagcttcccaaagtgctgggattacaggcatgaaccaccgcatctcactgaataatgtttaccttgatttctccctcctctgatggtgttgtgactcctgcctcctttctgtttgcatttggctgatatatctggaattattctgcctcaattatattgtttcaggtttgtgctttgcagttggcagattgttgaatttggattggatttacccaacctgggagtcattttctttccgtgggcatgtctttttttaaatttatatttgcttccataacagatatctttggtcttaattctactttcttgttttatgttttatatgcttccattatcttatttcctaatttttcctaccttctgctcatctggcaaacagaatgtgttttgttctactggtgattgttttttatctttgaattacaaggtttaatttacacgttcaaagttttcaacttcaaaaatgaaaaagtagctgtcagccagacacaatggccatccctgtaatcccagcgctttgggggactgagatgagaggatcacttgagctcaggaatatgagaccagcctggacaacataggaagaccctgtctccagaaaaagcaaaaagcaaaaactaaaataaaataaagtaaaataaataaaagtcctggctctgtggctcacgcctgtaatcccagctactagggtggctgaggcacaagaatcatttgaaccctgggagggggaagttgcagtgagctgaaatcatgccactgtactccagcctgggtggcagagggagaccctgttacaaaaaaaaaaaaaaaaaaagaaagaaagaaagaaaaagaaaaagtagctgttgactccgcttatggaagataagaaaattgattccattccaatttctcattctgtcttcacctctatcttctggttttcaattatatgctctgggaatttttgtctcagtcttttaaattttggggttataatgctatatatattttgctttaagaactataatagctacattcttcacattctgttttataatttttccatggttatttatatttaattttatatgtaaattgtctcaatgcacacccccatacaagcacttccttttccagtaatgctagataattttctagtgagttctttgttttgagtcatctcttagttgactgaagcatattttcaagtatttcctcccccacactctttcccccacaagaaggatatatgggtgatatacttcctaaatccgtgcatatttgactcacttgtaaatatcaactttgatgaaattttggatcctattctttttcttttcattgtctttcttgctgcattttcttctggaatctaatgtcagagttaaaaattgaggccatctgatttttattttctttgaagacaacctgcttgttctgcctgaattttcattagactccctttttccttgaaatgtaatggtttcatcagagtctatgtctcactgctagctttttttctctgcttataaatttccttggtaaccctttgagctgaacattcgtatctaccttcacttcagggatgtttcttctattcatatttcctcctcgaatattctccctgttgcatttgtcctatttcttatcctccaagaacacaaattattcccacgtcaattccacatttccctcttctctatgtgtggtcagtgtatctgtcaggatctggtcaggagtcaaaaaacataacacttattttaatagaaataatttaatgtagataagtggtaaccaggtacaaaattgttaactcggtactgaaaagacaaaaagagaacattaacatataatagaggcaacagctgcagagagcaaccattacccaaagggctgggaaacaaagggaagaaactggcagtgttaaaacagggccaggtacagtggctcacacctgtaatcccaacacattgggaggtcgaggccggcaggttgcttgagctcagaaattctagaccagtctggccaatatggcaaaaagcccatccctacaaaaaatacaaaaatagccaggcatgatggtgcacgcctgtagtcccagctactcagaaggctgagatgggaggatcaattgagcccaggaggtcaaggctgcagtgagccgtgatagcaccactgcactccagtctgggcaacagagtaacatcctgtctttaaactaataatataaatacatacatacatacatacaaacttagaagattagaagggctctgcaaagctgaaaatcagacctctgagtagggggccagtgcttagctgtgctggtgtctgagctcaaaagtgagagcccatgaagctgagaccaggatttactggccttgtactccaagcgaagcatttcacacatccccttgccaaggcctggaacaatgacaggttttatgcaaacatacttttaggcgagctgttttcaatcttgcctacacattggaatcacatgaaaaattgtttaaaatactgatgcctggataccaccttttgagagtctcagtaaattggtctggggtgctgtctgagcatttcaagtttttaaagctccccaggtgatgctaatgtgtagccaaggttggcggccattggcctagaattacctctgcataggacctgttaccactgctgagaacaaggaataggtcaatgtctaccttggttttatattatattcacctgagaaaaattgttttaactggtgacggccctcctttcccctagaagtcctgatttaattcactggagttggggtcaacattgagattttttatttccacaggtttttggggaacaggtggtatttgggtacatgagcaagttctttagcggtgatttgtgaaattttggtgcacccgtcacccaaacagtatacactgaacccaatgtgtagtcttttattcctacccccttccacccttcctcccaagtccccaaagtccattgtatcattcttacgcctttgcatcctcatagcttagctcccacttatgagtgagaacatacaatgtttggttttccattcctgagttacttcacttagagtaatagtctccagttccgtgcagattgctgcgaatgccattaattcgttcctttttatgactgagtagtattccatcatgtatatatagagagagagagcacggatttttaaatcccaggggattctaatgtgcagccagggtttaggtaaaggaaagacccataatgcctatgtcccgcatcagtgagttttgataagtgaatcctagacatcataaagaagcaaaatgtccaagcattatgtcaacatcaagaagactaggatggtgggagaagtctaacaattagaacactttaacagggatctcttcaccatgagagtcagaaatagaaacccagaaggcctctcctctctctctcccccactccgacttctctttctctgtcttctagctctcctatcacacacacacacacacacacacacacacacacacacacacacacattcatttgttctacagtcgaaagaacagcattagaagaaagttgtccaggtgcagtgtctcacgcctataatcctagcagtttgggaggcagaggcgggagggtcacttgagctcaggagttcgagacctgactgggcaacatagtgagacctcatctctaataaaaaaaaataaaaataaaagttatgagtatgagctgaatagataaatttccatttcctttggtataactgtggggtagctttgggccttattgtcctagggggatggttctcaaagtgtgatccctggaccagtagcatcggcatcacctgggaactttcaagaaacgcaagttcttggggtctacccaagatccactgaatcaaactctggaggtggggcccagccacctgtgttttctacgagcctttcaggtgactctgatgcatgcttaatttgagatccactgcccaaagcagtggcatctggaaaagacacaccagaaaaacacaaaacattacaaggcctatgcctcaggagccccttcagtagatgactgccaagaatagcccactcaggcagggtgcaatggctcacacctgtaatcccagcactttggaaggccaaggctggcagattacctgagatcaggagtttgaaaccagcctggccaacatgatgaaaccctatctctagtaaaaatacaaaaaaaattagccaggcatggtggcacatgcctgtaatcccagctactcgggaggctgaggcaggagaattgcttgagctcaggagacagaggttgcagtgagccgagattgtgccactgcactccaacctggccaacagagccagaccgtctcgagagaaaaaaaaaaaaagtagcccaccctccctctggtagatgaactacatcaccatagcaacacaaatgctcctggtgggtctcagatgttcaccatgagaacatctttccttaataacctaggaggtttgtatgtagtcagactcttgtgccctttgtccctttgcttgcctgtgagaactaataccacctttgtgcctttttcttcagcatgctaagaactatttttgtctaatcccacttcatcctctcaaattggtgcaacttctcctcggattttgacaatggatcttccagtggtcttcgctttgcctactgttgtgacttttttttttcctgtagtataccttcattaatgcctcctgaggtctgttgcattagctttttggatatccacatcaaactacagacactgattaaactcacagtaaactaaagctcctgattcattttccatgagtaatactaagtcatatcttcttccatcttttatctaagctgctgatattttggacccaagtatacaacctcacaacatcttgcaatattttagcatgtcattggtaaaatatcatcagttatctattgttgtgtaacaaaacatcccaaaactttaaataacaatcatttatttgttcatgattctgcagtttgggctgggcccatccaggcagctcttctgctggtcctggatgactcatggagtggtagtcatcttgtagctcagctagagctgaagggtctcagatgacctcactcacatgcctgtggccttggtgctagctgttggctgggatttctttccacatggactcacatactctaatagtctagcccaggctttcttacatgggagtgtgagcacgccaagagggtaaagatggctctggaaatagcacaacttcactgctgccgcatactgttgaacaaaacaagtcgtaaggccagcctggattctaggagtggggtaatagaatccacctcttgatgtaaaaatgtacaaatatctcatggccatatgtaaactaccacatcttccctgtctcgtttctccactttctgactggttctttctgggatcaccccccagataaactacttatacacaaatccttttctcaggatctttgaaggtcactctaccaaagaaactcaggctcagagcttggtccagaaacttcatctcttctcattccattcttgccttagcaatctcacccattcaaatgtatacaccaaaaacttccaaatttctacctctggcctcactcagacagaatatccaactcttctcacaagcccactggaggccttccaggtatctcaaatttaatatgccagattgaagtcttgatttgcaataccccgccaacttcctctgccagccatccccatctcacctccatatgcctaattggcactccaatggcccctccatgacattccaaaaacttctccatatcccaccaatcctcatgtcccaatgattattcttccaaatacttctcaaattccttttctcatcacaactgccaccactgcggtccaaaccacccccatctctctactaactgatctctctgctttttatcttgttcccccactccaacagcagcttagaaatcaaggacaacagccaaatattcagccaaggaaagctcttgcctggtccatttctgcaggaccttctacattttctacctcaatcagctagtcactgtgagaactactgtaaattaacaatatattgtagatcaggactaattgcaataaatatgttattataattctcaaataaaatgttggcttccattaaccaagtgtgaaaattttgattatggtgttttgcacatatgtccatagttactatcaccaattagcaagctaatgccccaaacaccctcattagtgcattcatttatgacatatcaacaaaaataaaaagctatgatgctgtgactttatttttctaaattccattaaggacaaggaaaaaaatcatagtactatttatgcaaggttgtagaagcaatcattacacattacaatataaaacccaaccacattttcaaagtgtttgccgagtgtacaattccataaaagagaagtgccttgcatagaaacaccgccatgccttggatattgctggtacttaataaacgtcctttgactaaagttgttgcatgttagagctgcaaagttttttgggactaattctgcacaattatgaggcttagaagagtgcaatgactttgctagggcatcacagcttggaagtaaagctaggaccagagacttgctgtaagccagagtttgtcaacttcagcactgctggattggtaactttggtttggataattccctgctgtagggctgtcctgtgcattgcataacatttagcatccctagcctctctaccaccagatgtcagtaatatcaccccaaccaatcaagacaatcaaaaatatctccagacattgccaaacgtcctctggcaggggtggggaagaatgcaaggtactgcagaatccccctcagttgatatattggtctgttttcatgctgctaataaagacatacccaaaactgggtaatttataaaggaaagaggtttaattgactcacggttccacgtggctgaggaggcctccaatcatggagaaagtgaacttggagcaaaggccatcttacccggcagcagacaagaaaacttgtgtaggggaactccgatttatataatcatcaaatctcgtaagacttactcactaccacgagaacagtgtgggggaaaccacgccatgattcaatcatctccacctggccctgcccttgacacgtggggattattacaattcaaggtgagatttgggtagagacacaatcaaaccatgtcagtcgagaaatattgtaaatgtagattagtggttcttaaaatgtggtccccagaccagcagcagcagcagcatcacctagaacttgcttaaactgcagttgatcaggccacactccagatccactgaatcaaaaaccctgggggtgcgtcccagcaataagccctccaggtgattctaatgcacagtcaagtttcagacccagcaataaagattatccctaacccttgcaaggtaattgctcatgttccagtttcataaataagaaaatcaggctcaaagaggttacctgttttgcccaggttctgatatagcaatggcagagctaggacttgaaatgggctcagtataacaccagaggccagctctttctgctctgccttgcctccttgaacacaaggcagcagggaaaaggaaagcctggactggacttcaggctgactctctcgtaccacgagcaccacgaagacaaagtccacaatgccacagctgtcaggcctctgagcccaagctaagccatcatatcccctgtgacctgcacgtatatacgtccagatggcccgaagcaagtgaagaatcacaaaagaagtgaaaatggccaattcctgccttaactgatgacattccaccattgtgatttgttcctgccccaccttaaccgagcgattaacgttgtgaaattccttctcctggctcagaagctcccctactgagcaccttgtgacccccgcccctgcccgccagagaacagccccctttgactaattttcctttacccacccaaatcctataaaatggccccacccctatctcccttcgctgactctgttttcggactcagcccgcctgcacccaggtgattaaaaagctttattgctcacacaaagcctgtttggtggtctcttcacacggacgcatgtgaaaacagccgcttttgtggttgccgtggccctttgggggtatgaggtaagaaagagaagagtctgagcctaaagaggatcatcaaacctactagatgctaatgaggccaaactgagcacattaggggcaaagacactgtgtctccagacccactcccaaatgagcatcctgaatgaacctttacctacccagctcccctcttttctggggaccctctctaggaaccttccccaccatttacacagttactatagaagcaacgattctgtatcccatgacctcattcctccagccacagctgtttggctcgtggtggccaagggagcttgacctaagttgaaccaattactccctgtcctgaaattctggacatgggacaaagcgagaattgaatctgtccctccctatgagggttgaaactgagatttcatgctccagagctattggtcgcaatgttgttctaccacttccatgcaagtttctttcacttacaacccaaagagatctgactcaaacaagaaaacgtccctttcactattacagccacccaagggtaagaataacatttcacaacatgcaggagacaagggggaaataaaccatgcaagcttcaccctcaactcagagaggtgtgttctggaaagttcctgcccacctcgtccatgacctgtggcctctgaagatagtgctagtctccttgaaaaccagagccatatgggatcccttggccccagaagttatcactagaatctccccaccatgcctcaagctgatggcaagattccacatgggaaggaggaagggaaaacattgtgagtcaagggactgcaagttactaaaggttggagatatgtttaagagacaaagaaatgcgggtattttggaggaaagagtgaagaaatacttgaaaagctgtgactccagactccccccaccgcttccaaattaacccccaccatattcaccactgaatccacaacaatgaaaagtgcctgaggcaaagacagcatacatgctcttttgctaggtgaagagagggagggataaatgttcaatgagagccttgtgtttctctaaaggcacagaactaggagcatctggctgaggtgaggggcgaggacttggggtgaacctggcaacaccttttggctggcagatcacaggtaggtggggaaagttacctcaaggagtgtagaaagtaaaccaaccacggagagaaaagcctgcctggaaactgaccaactatgtaattctgagctactcccttcacatctctgagcctcagtttccccatctacacaaatatagcgctgtcctagctctccctctctctggtccctttcttctcccaagtctgagaaaatttcatggggtgggggtgtccccaaactgttaaagcagagccgtattccaagtccttggcagagggggtctcactgtccatctgctggttctccatgcagagagacaccagaatgggtgggtatttgggaggtctccaacttctctgagaacatcactgcagatgctcctgaaaagggtgagacgtgggccttttggcgagtgagaagtttggagtactgccagtcagtcccgtctgtccccatgctcaccagacaggcaccatcccccagtgcaaagcaccaagaattccccatgggggtggggagaaggcatcaggtggagccccttcccccgcttccctgcccaggtatcaaaagatgaattccaggaactgccgggatggtgatgatggaaattacgcaactctcccacggagacacacacggccacatttaggggcatccttttgtcccagtttagtccacttctgctcctcgttgccctgggcagtcaagtctcttttacaaagatgtttctcaagccccaggtaatgtagatacaaatacagtcatgtgtcacttaatgatggggataggttatgagaaatgtgttaggcaatttcgttgttgtgtaaacatcagagaatgtatttatgcaaccctagatagtatagtctcctatgcacctaagctatatgctatagcctgttgctcccaggctacaaactgttcggcatgttactgtcctgacgactataggcaatggcaacactgtggggagtatttgtgtatctaaacatttttaaccaagatgactgggtgcaaattactaacaaacaatgtcctttgattgagaactcacaggccgggcgcagtggctcacgcctgtaatcccagcactttgggaggtcgaggtgggcggatcacctgaagtcaggagttcgagaccatcctggccaacacggtgaaactccgtctctactaaaaatacaaaaattagccgggcatggtggtgggtgcctgtaatcccagctacttgggaggctgaggcatgacaattgcttgaacctaggaggcggaggttgcagtgagctgagactgcgccattgcactccagcctgggcaacaagagcgaaactctgtctcaaaaaaaaaaaaagagagagagagaactcacaatatcctagggactgtgctaggcttccttcacttaactgtcacaacaaccctatgcaggaggtagtctatcccctatcgaatactgatgagtaaactgaagttcagaaaggcaggactcagagactgggactagcaagactagagccagagtgcaagcaggtgtgcgctggtgtgtccagcatgggagattctctggtattaaaatctaggctcagaggccgggtggaatggctcacatgtgtaatcccagcactttgggaggccaaggtgggcggatcacttgaggtcaggaaggagttcaagaccagcctggccaacatggtgaaaccccatctctactaaaaatacaaaaaattagctgggcatggtgttgcatgcctataatcccagctactcaggaggctgaggcaggagaatcgcctgaacccgggagacagaggttgcagtgagccaagatggcaccactgcactccagcctgggcgacagagaagaactccctctccaaaaaaaaaaacaaaaacaaaaacaaaaacaaacaaacaaaaaaaaggcactccagcccggacaacaagagtaaaactccgtttaaaaaaaaaaaaatctaggctgtgctgggaagcggtgtggcacagtggttaggggcacaagctctatggacaagagcttgcaaacgcaaatcccttgtgccctaaccactgtgccacactacttccggcatagcccagatcttaaaaccaaagaatctcccacactggacacaccagttcctcacctgctggcactccagctgcggcctcactagccccagtccttaaagagctgccacacccctgctcctgccacatcctttcctctccctagaatgtttcaggctctgctcatggtccctcctccatgaagacttcctgagcctcccaggcccctaagagagaattaacccctctctccttcactccacccctgctggctctagatgcatccatcacaggaaacgttcccaatatttttattttttcaattttattttagattcaggggatgcatgggcaggtttgttagaagggtatgttgcatgacattaaagaaaatgtggtacatatacaccatggaatactacacagccataaaaaagaacggattcgcgtcctttgcagcaacatggatgtagccagaggccattatcataagcaaactaacccactattatttatatacccattgcagccttgtggcttccagtcttctgggaaatataggccaggccttacccatttctgtatgcccaggatccaacaccgtgccaggcacacaaagactctcagtaaataatgagtgaataaccaagtaaactaaaacctcacccaaaatccaatctcgagctacccaagacagcaagttcatggggcaggaatgcctggcacatggcacacgctttctcaatacaaacttacatcatgaataaaataaatgaatgatagcatagctgaggatttacacccttatttctagtaactctcattgtaggtgacacaaaggattgggtccagatacaatcttaatgtattagttcgttctcacactgctacaaaaaaactacctgagactgggtaatgtaagaagaaaagaagtttaattgacttgcagccccacaggctgtacaggaagcatggctaggaggcctcaggaaacttacaatcatggcagaaggcaaaggggaagcaagcacctcttaccacaacagagcaagactgagagagagagcaaatggggaagtgccacacgtttttaagcaaccagattttgtcagaattcaccatcatgagaacagcaagggggacttgcgcccccgtgattcaatcacttcccaccaggtccctcctccaacatatggggattacagttcaacctgagatttgtgtgaggacacagagccaaaccctatcacttaggtttggaaagggaaacatcagacttgctagttgaaaagcaactttgtaaaccttaagccattattcagggacagtaaaccttcaaaacacaataagaaaataagtcttcaatgcaaaactttaacaattaaaagatgttagtcgttctgcattgcaaacaggattaactaaactctgggggtaaggagggtcataagatccccaaaataaaattttaatatggtatatgaagcctttctgagagttgaattcttccagaagcagaccctgagacaagaatttgagtgtaagtaatttatttgggaggtgactcccggaagcagcagcaaggaagagggaaagaaagacagaaaggatggaagccaattaatagcatgccgtcagtccagttaccaccgtgggcaatgagagctcaatcctactgggtagctctggggaacagtatggaagacttggctctgaattaatccacctaaggggaaggagaggtgaggtatttatactccaactcccatctgtcattgcctactcccagagccattaactccccagtgttcccagccctccaagcacagggctgagaggaaatcctcaagtggagacaccttcttacatgtacagggacagcaagtggcaaaggcatgagtcggggtgagtgagcagggccagctacaaagcccaagaggaaaacctggtgtgataagaggaatttgtttccaactaacaggcatcagaacctaatgaaaactaagcaagaaagtggagatctaagacaaaagaaaactctgggccgggcccagtggctcatggctttggaaggccgagatgggtggatcaccagcgatcaggagttcaaaatcagcctggccaacatggtgaaaccccgtctctactaaaaacacaaaattagccaggcctggtagtgtgtgcctgtaatcccagctacttgggaggctgagacaggagaatcccttgaacccgggaggtggaggttgcagtaaactgagattgcgtcactgcactcccgcctgggcaacagagggagactcaatctcaaaaaaaaaaaaaagaaaaaacaaaaaaaagtctggacagagaagaagttagaaccttccatctgcctctcctctgttccctctgcaatgtgtatgtctggctttcgtcttctctcccctccccaacctggaatctattttcttctcagtctgaatctttcttcctcttccccctcaagagctccccacccacccctcctgtcccgattttctcacccctcaagagcccataacatgaaagtgaagtatcttgcttaatatttgtttacttaggaacagtgagttttatgtacactgttcttaattaaattctcagcaagtttctatttgtggatggagaggcattctgcccaaggaggggggccttacaatcttggcaccttgttactgattcaccccccagcacttggaaggaacacttgggattcagtctttcatttggggcccatgaagctactcgtgttctcagcaacactgattattggcaatttccctctgtgagggaagtagatttccttccagacatcctgtagtggtgtttccgaaggagtagtgactcgctgcttcatctgcgtgggcggcccgatagataaatgctcatgcaacgcgccaggcgggggatctacaaggaagcacttggtctccacccaaatcacagtctggagttctcgctccccgctgtcatttctgggagtcctctctaaagggctgcatcaagaaagcaagcttctcactgtcttccggacccttgactttcctcaagaccacccggatgtcacctcctccgaggagtcttccctgactaccttgagccagcagccaccctctgctttgtgctccctgaattggggtccacctgcttggacagcaggcccagattgtgtgtctgctcaccaggctgtgggctcacagaggacagagtctccatcttggtcgcttgtctccctgaaagtttagcatagagtataagcttagtaaatgtttgttgaataaatgaatatatgaatgaagggattgaatgagtgccaggaggacttactggagccttggacgggcttgtaggaactcttgggctgacagctagccagaaacgtaaggagcccagagtccaggaagcctggtgtttttcaccccgggctgggggcggggccagaggaggcctaagggactgaatttctcccagatagagccaggaatcttcactcctgttgatcttacatactgggcttctagaaatggagttccactcctttaaaaagttacaaaaccggccatgtgtggtggctcatgcctgtaatcccagcagttcaggaggccgaggtgggtgggtcacttgagaccagaagtttgagaccagcctggccaacatgatgaaaccctgtctctactaaaaatgcaaaaattagccaggtgtggtggtgcatgcctgtaatcccaggtactcaggaggctgaagtaggagaatcgcttgaacccgggaggtggaggttgcagagagacaagactgcgccaccggactgcagcctgggtgacagagactctgtctcaaaaagaaaaaaggttagaaaaccattattccacattccagcctcagcatgttttagactggcatggcatagtcaagggaggctgctctgggacctgggcttactgactccctggcccgggctggctcagctcaaggccacagccacagccacccacaggcatggttctggctcctactgagggcctcacacctgaagactcagccagagggggcacccgcccagccctgtaattggagtctggggtcgggagatgggtgttgggcaactgggctgcgggggactgaggctaaccgcctccaggtgtgggggaggccagaggacatggaagggagaccgcaaggtcagggtgaagctcgggagcctaggctgggttcatggggccaggacaaggtcccttccccaagcctggacaggtgcatcacaggcagccacagccctgaaagatgagggttaggagagcctggagcacgagctgaaacgggtgaatctgcgctggacctcaggtctccctccccgcaccctgcgttgtagggaagagcaggaaccctggcggcctctgaggcgggggcggtggggggcgctgggggcgcggagttgcagccggcagaggagcagtggcgccacctcctgacgccttcggggaacgcagctgatgccagccagcctccggcctctgaagggggcatggggtgggggaggccccgggcccaaaaaagcagatcagctatttacttccccatgcacaattttttttatatgttattaaggaaaacttgaaatatgtacaaaagtagagagagctgtcataaactcccagatacccatcgttccacttcaccaattcgctcatggccaatccgacttcctctctaaccaccctgcactttctcctccccgatgtatttcaaatcagattaaatcctgggcattatatcatttcactcctaaatgtttcaatatgtaacataagtatttttaacaatacaaccacaataccatattccacaaaataatacttatttcttatcatcaaataatacagtctcataaatttttaaatgtttttctacagtttattaatcatgatcctcataaagtccactcactgcaactagcccactgtttttgagtgcctcttcctctgtatgcctcccctcctttctgtcttttttccttgcaattcatttgttgagaaaacctggttgtctgtcctgacatgtcccatagtctggattttgttgtctgcatccctgtcatataatttcacgtgttcctcagattttctgagttgtagattcggtccgttggagttgaatccggaggtttgttcagattcagctttggtctcttcttgtgctgtcagctgccattggcaatcattacctgcatccattatgtcaccggggactgtaaaatggtgatattccaattctgtcattagcagtttgcttttttgctttgttttgtcttgttttttgtttttttgagacagtcttgctctgtcacccaggctggagcgtggtggtgcgatctcggctcacagcaacctcagcctcctgggttcaagcaattctcctgcctcagcctcctgagtagctgggactacaggcatgtgccaccaagcccggctaatttttctgtttttaatagagacagggttgcaccgtgttggccaggctggacttgaatgcctgatctcaggtgatctgcccgcctcaacttcccaaagtgctgggattacaggcatgagccaccacacccagccagctgtttgcttttaaatcagaggttcattatgatataggcacaacataacagtattcataacaaggataaataggttattgccatcaagcaaaagatagggagtctaagatttgatgaacaatgtaagatccagtactgtgctatttacgagcaagcacttaaacaaaaggatacagggagattgaagacagaaggattaaaaaggatatagcagacaaatatgaaccaaaagaaagctaaggtgatcatcctaatacctgacaaatataagttaatgcaaacaataatgtcataagaagaattacagattttcaaatagccacccatgagcatataatttcacgaaaaactgtagcttcaaaatacataagatatcaggctgggcgaggtggcttacacctgtaatcccagcactttgggaggccgaggggggtggatcactttaggtcaggagttcaagaccaggctgggcaacatggtgaaaccccatctctacagaaaaaaaaaaaaagaaaaaaagaaaaattagccaggcatagtggagagtgcctgtggtcccatctacttgggaggctgagataggacgatctcttgagcccaggatgtggaagttgcagtgagctgagatcatgccactgcactccagcctgggtgacagagtgagacccgtctcaaaaataataataataataataagatgtcaaattacagaattgcatagagaaataaatctacaattattatttagagaatttaattcatctcccctagaaactgaccaaacccagacaaacaactatctcaatcagcaagctaataagtagatgcagaacatcacacctccaatcagggtgatgctcgctgctcccagaattccaaacaggcctggcttcactcaggcgactcctagaattctgagaggcccagccctgctggcagtgtgacagggtcagattttgagacccctatgcttctctgtctttgcacacaaagagaaccaccttagacttgagcgaccaggacctccctgccttgtgcccctatttagagggcccttctctggccttcctatagctatgccccgcccacagggcatggaattcgtaagaccaagagcataagcccaccttcctggtcactgctgcatggcccaggaaggggaaggggcacaggtaggacctgccgaaatggtcctgagcctgcctctaggactcacatcatttttctttgggtccttcctcccaacgatggactgccctcagtgtgtgcactctcaagctcaaagagcctaaaggaggctatttgttggggggatgatggaggtgagaagggcttggagatggagagtggactgaccacagcatgcaggaagaccctttgtggtacagacaaagatggggatgggaggagaaaaggaggagctacagaccagagcctccatctgtgctcttgcccccaaacctctcatgtgttagagttgcacacgaacgtcacaaccctgatcacaccccttcccttcccctccgaggctggtgataaaacacaaggagcaaaaacaatcactgctggaggcctaattatggcaagcagcctggcaatgctgtatatagactctgctttgagcaaaatgtgctgatttatgcagtttccaacatttaaaggtggagaccagactgtggctgaattggatcagatcattctctgggacaaattacaaccctgggctgctgagcaaaaatttgtaaagaattgtctctctctcctgccccttctttcccagaactaccagctccaccatggattctctggccattcctttgaccctttgtcccttcctcaccccagcccagcacaagggctggcatggagtggcagcttataaaacatctgctgaatgaataagtctatttcctagagggtgagccctattggatggggtgcactggacaaaaccacctaacctagtgtcaaccatagaagcttaggatctagactactgggttcaagttcctgttctcagtagccctttcttgtagacccacagtccccaagttgtgtgtcaagacatctgtgatgaactgaatgtttgcatcccgcaaaattcatattttgaagccctaccctgcaaagtgatggtgtttggaaacggggcctttgggaggcaaatacagttagattaggtcatgagggtggggctctcatgatgggattagtggccttatgaaaataggaagaaagatcactctctctttctgccatgccaggacacagtgagaaggcagccatctgcaagccaggaagagagccctccccagtactcaactttgctggcatctcgatcatggacttctagcctccagaactgtgaaaaagtaaatctctgctgtttaagccacccagtttatggtattttgttctagcagcccaagaagatgaagataacactcctagggtccaagtgcaatggctcacccctgtaatcccagcactttgggagcccaaggcagcagatcacttgaggtcaggagtttaagaccagcctggtggacacagtgaaaccctgtctctactaaaaatacaaaaattagccaggtatggtggtggacatctgtagtcccagctacttgggaggctgaggcaagagaatcgcttgaacctgggagatggaggttgcagtgagttgagattgcaccactgcactccagtctaggcagtagagtaagactttgtctaaaataaataaataaataaaatagcactcctaggcactgcagcacacacaggaggggaacatttattatcttacctgttttaaagaaacataatatttgtcagatacccacaaactacagctcaaggcagttcactgtttcaacattagcttgtgctacatcgctttcagtgacatcatatctttgaaaagctgggttttctgtagttacagttataaaaagcaaacatcacgtgaaaatcaatgtagaacagaaaatgaaggaagcaacgtccaatctgattcaagttttgagaagctgtgcagtgcccaacaggcatatgcatacatcccatgactatgtcattctggttgagatggaagaaaattattttttgtttcaatttatgtgagttattttttcaaacagtgactcagctgttagggcataaagagttgtaagttgtctgcacctaattacttaataaacaaaactattaggtatttctttaggccttggggcaccatgaaaaagttactgagacactgaaggcattgggaacggagaaactgtgggagtccccgtgttaggcattttacttcatcttatctgggcgtcagttttcctatagataaactggaggccaggcacagtggctcgcgcctgtaatcccagcactttgggaggccgaggggggtagatcacctgaggtcaggagcttgagaccagcctggccaacatggtgaaaccccatctctactaaaaatacaaaaattagccaagcatggtggcagacacctgtaatcccagatacttgagggactgactgagacaggagaatcgcttgaacccaggaggtgggcgttacagggagccgatatcgcaccattgcactccagcctgggagacaagagtgacactccatctcaaaacaaaaaaaacaaacaaactaacaaacactggagataataagtatatatcgcaaggttattgacaggatgaattaagtgaagataaatgcagtatttagaatggtacctagtgcataacaatagctgcatatatgtggttattattacacagaaaggccaaattggtagttgtaattatcacagggaaaatgtctaaaatgcagcaaagaacaattttccaacattctcttttttattaataatgtaattaccatataccaagtacttggacatgcattacaaagagcactggactgggagtcataaggagatgtgttccagccacagttcagccttgaaaccttgagcaaggcactccctccccctgagcctcagtttccacatcagtatatcatatgtgtggtggtgaccatgggttttgtggggcagggttaagactctttcctcaactgtgcaaacaccaaagggaccaggccaccgatggggaagttcctcctatattacaaacagagaaaaacttaagaagtcgttaatattttgaaattgatctgctaattagaaactctctttgggctgggcgtggtggctcacatctgtaatcccagcattgggaggctgaggcaagaagatcacttgagcaccggagttcaagaccagcctgggcaacatggtaaaaccccatttctttttttttttttttttttttaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgtcattctaactggtgtgagatgatatctcatagtggttttggtttgcatttctctgatggccagtgatgatgagcatttcttcatgtgttttttggctgcataaatgtcttcttttgagaagtgtctgttcatgtccttcgtccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaattggtaaaaccccatttctataaaagaaaaatgaataaatatatatatgttaagaaactgtctttatcagctcattgggataagtttctcttgactctggaggtcactgaaggaatcagtttctcggcttcctctgagtcaaaggtaatgaagccagtcagagctccaaaatcattggcttccaactgatccagacctttcactaaattagaccatctcagaatgtgtcgaaatagtgagggttttgccagctgtataatcagttccatattcaatttcttaaatagagatttgttgataaaccaacctaccatttttaaaatgtagttttgtcttccccccccccaaaaaaacaaaagactttcttttaaaaaaagatctcagttttcatcagatcaaatttcctttgccatttgcctctagggttcctagggattctgattttttttaatgctgagttcactcctttatattagatcgtcattgaaatggacctcactcccatagaggggtgattatgggtttattccttttgcaaggctgatggctgacagaagtgatactgctggtagcttcaaggaaatgtgttttataaaacgaggactgagattgttataaagctgattttggcacgtttttctaacttaaaaaaatgaaaatggaaaaatggtttctctcagatgaagggttctgcgtgtatacacaggatttcaaaatctaaagccccccccctctccataatagaaataaagatgagtgtcactccctgacctccacttcccattctccaggccagccaggtctgtctctaagcctggagcagaaagctgagctacccacggctcccagattctccctgacggcacatagcatttggatgtgagaatgttcagactcaccccaacaaaacaaatgagtacctttgagcttttaaaaaaaaaaccaccttggtcaggtgcagtggctcacacctttaatcccaacattttagcatgccaaggcaggagtatagtttgagcccaggagttgaagaccaacctgggcaacatagccagaccatgtctctactaaaaagacaaaataatagccaggcgtgatggcccgagcctgtagtctcagctactcaggaggctgaggtgggaggatcatctgagctgcggaggtcgaggctgcagtgagccatgatcatgccaccacactccaggctagaacctgggtgacagactgagaccttgtctcaaaagaaacaaaaaatcaccttggctcacccttgaaactgattccatgacctcagagacacccttggtagaaaaatcaggaaaggcctcccacagttaagagttaggacccagaccatccttcccatgtagcttctagagccagatggtccaggttcaaatcctggctctgccactagccagctgtgtgactttgagcaagtcacttaacctttctgtgctttgcttttctcatatgccaagtggaagtaacaattaagaatcaaatgacttagtatttgtaaaagttcttaccataagagctagtgcgcattatttgatgaaagcaagcggctggggttttgtcttatgcctggccaacagatggtcgtcctcctctcccagcctgcgcctcagagtgatccatgtccccagtgagctcactgcccacttcctaactttcacccactcctgccttccgctccagagaaaagtctgttcaggccttaacattgctcaacaactcttgatttttcctagtccatccttttgccgtcttcatggattcagtgtcagatctgcctctcccaccaaatctctgagcctcactcacacttggcttctctccttcacagagaaaataatgctgtcaaacagaaaccccacaacctccttccatgcctctcactctgtcctgctcctgaccatgcctcctttctcccctactctccttcttaccagagtggaggaggtcccatccctccaccatctgaggttggttgccatccccagtggggcctgccagtgcagttgtgccggttgtgcactgtacaagggcacctagccaaggtgtcagtagaaacgaaaatccaaccaatttgtgccttccaaatcctttatcccagcaggagatacccagacatgtgtgctttttctaaatcatccactgagaagggcccatttttcaaatttaagcaacaattttttttttttttttgagatggagttttgcttttgtcatccaggctggagtgcaatggtacgatctcggctcactgcaacctccgcctccttggtttaagcaattctcctgtctcagtctcccacgtagctgagattacaggcgctgccaccacgcccagctaatttttgtaattttagtagagacagggtttcgccatgttggctaagctggtctcgaactcctgacctcaggtgatccacccacctcggcctcccaaagtgctgtgattacaggcatgagccactgcgcccggctaaacagatatcttataggcaagtggagatcgtggcccctgagctcaaaacctcagatagccctgttctttcagagcctttatcacactgtcacctctttattagcctgtcctttatcagcttctaccttcagtctcagagctgtcgtgagcagaggatgacatgaaggaaaagcagccaacacttgaaatggtgcaaagaaattaccgcgtatccttcagtgctgggtgttgcaagtcagatgcctcccccattatctgattctccaagaactgagctgtccaatacggtagccactagccacgtgcagttactaaacataaaacatgggtactcaaaatcgagctgtgctgttaggtacaaaacacacactggatttcaaagacttagtaagaaaaaaatgttaaatatttcattaaggccgggcacaggggctcatgcctctaatcctagcactttgggaggccaaggtgagaggatcacttgagcccaggagctcgagagcagcctgggcaacagtgcaagtccccatctccacaaaattttattttaaaaattagctggacatggtggtgcatgcctgtagtcccagctacttaggaggctgaggtgggaggatggcttgagcccaggaggtcaaggctaccatgacccacctgggcaacagagtgagacctgcctcaaaaaagaattttcattaataattcttatatcacatgtttctagggctatcataacaaagtagcacaaacagcgtggcttaaaacaacagaaatttattgtcgtacaactctggaagctagaagtccaaaatcaaggtgccagcaaacccatgctccctctgaaacctggaagggggaaccattgcctgcctgctttctagcttctgatggtggccatcaattcttggtgttccttggcttgtagctgcctcatacgtgcctctgtcgtcgcttggtgctctccctgtgctgtcacatagcatcgtcttagaaggattcccatcacagtagagattaagcgcccatcctactccagtatgacctgatcttaactaattacatttgcaacaaccctatttccaaataaggtcatattctaaagtactgaaggtgaggattttaacatgtattttagggaaacacaattaaacccacaacacatgtgttttgttttattttgttttgttttgtttgagacggagtctctctctgtcacccaggctggagtgcagtggagccatcttggctcactgcagactctgcctcctggattcaagcaattgtcctgcctcagcctcccgagtagctggaattacagatgtgcaccaccacgaccggctaatttttgtatttttagtatagacagggtttcaccatgttggccaggctggtattgaacttctgacctcaagtgatccgcctccctcaacctcccaaagtgctgagtgacctgacccggccccacaacacatgtttaaatgatactatttgaatacattgagtgaaattaaatacaatgattgattgcatttgaggcttacattacatgtctattgggtggcaccgctctaggggtgtgtactgtagtttgacttgttatttactattgattagggtagcttacaactctgaaaaagaaaagtgttaatccatagaaaaccaatagcaaccaataaactttatcctgtagcgatgcaaatgaaaagatcataacccaaagtttctggatttcttctgtatgtactttagcagtcttattccaacattctttctctttttatttatttttttttattataccttaggttctagggtacatgtgcacaacacgcaggtttgttacatatgtatacatgtgccatgttggtgtgctgcatccattaactcatcatttaacattaggtgtatctcctaatgctatccctcccctctccctccaccccacgacaggccccggtgtgtgatgttccccttcctgtgtccaggtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgatggacatttgggttggttccaagtctttgccattgtgaatagtgccgcaataaacatatgtgtgcatgtgtctttatagcaacatgatgtacaatcctttgggtatataccctgaaatgggatggctggttcaaatggtatttctagttctagatccctgaggaatcgccacactgtcttccacaatggttgaactagtttacagtcccaccaacagtgtaaaagtgttcctatttctccatgtcctctccaacacctgttgtttcctgactttttaatgatggccattctaactggtgtgagatagtatgtcattatggttttgatttgcatttctctgatggccagtgatgatgagcatttcttcatgtgtctgttggctgcaaaaatgtcttcttttgagaagtgtctgttcatatccttcacccacttgtcgatggggttgtttgggtttttttgtaaatttgtgtaagttctttgtagattctggatattagccctttgtcagatgagtagattgcaaaaattttctcccattctgtaggttgcctgttcactctgatggtagtttcttttgctgtgcagaagctctttagtttaatgagatcccatttgtcaattttggcttttgttgccattgcttttggtgttttagacatgaagtccttacccatgcctatgtcctgaatggtattgcctaggtttttcttctatactttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttagccttgtagtatagtttgaagtcaggtagcgtgatgcctccagctttgttcttttggcttaggattgacttggcgatgggggctcttttttggtttcatatgaactttaaagtagttttttccaattctgtggagaaagtcattggtagcttgatggggatggcattgaatctataatttaccttgggcaatatggccattttcatgttattgattcttcctatccgtgagcatggaatgttcttccatttgtttgtgtcctcttttatttcgttgagcagtggtttgtagttctccttgaagaggtccttcacatcccttgcaagttggattcctaggtattttattctctttgaagcaattgtgaatgggagctcactcatgatttggctctctgttattggtgtataagaatgcttgtgatttttgcacattgattttgtaacctgagactttgctgaagttgcttatcagcttgaggagattttgggctgagatgatggggttttctaaatatacaattatgtcatctgtaaacagggacaatttgacttcctcttttcctaattgaataccctttatttctttctcctgcctgattgccctggccagaacttccaacactatgttgaacaagagtggtgagaaagggcatccctgtcttgtgccagttttcaaagggaatgcttccagtttttgcccattcagtatgatatgggctgtgggtttgtcataaatagctcttattattttgagatacatcccatcaatacctaatttattgagagttttagcatgaagcgctgttgaattttgtcaaaggccttttctgcatctattgagataatcgtgtggtttttgtctttggttctgtttatatgctggattacatttattgatttgtatatgttgaaccagccttgcatcccagggatgaagcccacttgatcatggtggataagctttttgatgtgctgctggattcggttttccagtattttgctgaggatttttgcatcgatgttcatcagggatattagtctaaaattctctttttttgttgtgtctctgccaggttttggtatcaggatgatgctggcctcataaaatgagttagggaggattccctctttttctattaattggaatagtttcagaaggaatggtaccatctcctccttgtatctctggtagaattcggctgtgaatccgtctggtcctggactttttttggttggtaggctattaattattgcctcagtttcagagcctgttattggtctattcagggattcaacttctttctggtttagtcttgggaaggtgtatgtgcccaggaatttatccatttcttctagattttctagtttatttgcatagaggtgtttatagtagtctctgatggtagtttgtatttctgtgggatcggtggtgatatcccctttatcattttttattgcatctatttgattcacctctcttttcttctttattagtcttgctagcgatctatgaattttgttgctcttttcaaaaaaccagctcctggattcattgattttttgaagggttttttgtgtctctatctccttcagttcaggtacacctgaagataagaaacagactatgtgaactaaaagatggttgccgcttcacttcggccctccaaatctcccacaagaacctctcttagctgggcgcagtggctcacacctgtaatcccagcactttgggaggccgaggcaggcagatcacttgaggtcaagagatcaagaccatcctggccaacacattgaaaccccgtctctactaaaaataaaaaaattagctgggcatggtggcacgtgcctgtaatcccagctactcaggaggctgaggcaggagaatcgcttgaacccgggaggtggaggttgcagtgagccaagatcacgccactgcactccagtctgggcgacagagtgagactccgtctcaaaaaaaaaaaaagaacctctcttgtgtcccaccctaacaagaaatgtataggtaacgaagtttgtaaaatgtagttcatcctagctgaattcacatattttaaagccactatactagctaaggctaaaagaacagaacagattttttagtcccatcttctccggaagacttccagtcaatgcctaagcaaggtagtatcaaaggcttcgtcattgctgcccaatgggggaattcccttagtaggcaatttttgctccagagctcccccgtcaggctggcagaaatagtactaagaattcattgtgaggtgacacctcccctgctcaatcctgctttttcccattttctttcacaggtgacagtccacaataaattttttgtatttctaactctggcttagcatctgcatctcagaaattccaacaaacataaaataattttaaagcaaacattataactatactcaaggactgcaaatatgcttcaaataagcgaataaatagaaattttcaacagataaatagaaactacaaaaagaatcaaatgaacacgctagaatttaaaaattcaatatctggattttttaaagttcactggataggcttaacaagagatgagaggtgacagagagtcaacaaacttgaagataggtcaatagaaatatcctacctgtcctcacttcggcagtacatatactaaaattggaacgatacagagaggattagcatggccctgcacaaggatgatatgccaattcatgaagcattataaaataatttttaaatttttttaaaaaagaaatagccctgctgaagaatagaaaaataaaaaatggtgaaatttcagtgacctatggagcaatatcaaaagttttaactttgtatcactggagtccttgaaggcaagaaaagattgggacaaaaaagttttctgggttgggcgtgctggctcacgcctatattcctagcactttgggaggccaaggcgcgtagatcacctgaggtcaggagttcgagaccagtctgaccaacatggtgaaacgccatctttactaaaaatataaaaaattagccaagcatggtggtgcatgcctgtaatcccaatctcagctacttgggaggctgaggcaggagaatctcttgaacccaggaggcagaagttgcagtgagccaagatcatgccactgcactccagcttgggcaagaagagtgaaattacatctcaaaaaaaaaaaaagttttgtgaagaaataatggtcaaatttttagtgcaatttataaatttatacagtcaagaaattcaacaaactccaagcaggaaaaaatacaaagaaaaccacatatagatacatcataccaaactgctgaaaaccaaagataaagaaaatatcatggtattagccagagaaaatttacgcaaaacataatggggaacaatgatttgaatgacttctgacttcacgtcagaaatagtagagaacaaaagacaacagaaaaacaactttaagcctaggcaacatggtgaaaccccgcttttacagaaaaaaatacaaaaattagccagcatggtggttcacacctgtagtcccagctgtttgggaggctgaggcagtaggatcacttgagcccaggatgttgaggctgcagtgagccatgatcacaccactgcactccaggctgggtgacaaagtgagaccctatatccaaaaaaaaagaaaagaaaaacaacttaaattgtcaacccagaattctatatccactaaaatatacctgaaaatgaatgtgttgctatgtaacaattaccacaacctagtggtttttaaatttgcacattatctcacagtttctgtagattagaagtcagagccaggaatctgttctcacctggaagctgaactgacaatgaatcgtctcccaagctcactcaggttagtggcagaatttctttctttgagactgtaagactgaggctatgctgagcaactagatgttgcctgaaatttcttgcctggtgggctcagataagtttttgcaagcctccgtgctcacagccagtaagtaaaagagactctagagtcagctagcaagacagagttttttataatgtaccatatcatggcagtggcaacctatcacttttgccatattctattgtttagaagcaattcacaagtcccactcacactcaaggagaggagattatatgaagatgtgaataccagaaggtggggattattgggggtcgctcaagtcctgtccaccacaaggaagatgaaataaaaacattttaaaatgaatgaaaactaagagacttcactcagcagacctgcattacaagaaacactaaatgaagttcatcaaatgaagggaagtgacacagatgggaactcatatatcttcgagaagaagtgaaatccctggtgttttgtgaaaaggccatctatgcaaagcgacacccaaaaacagaaggagccaagaagccaaagaatgaggctgacaaatccagtttgtcagtaggaacttatagacagaagcgtagtcttgggtgacagcaagacaaaaaatctctgcaccgttactccccagacccagggcttttataccatagggcaagagtatatgtgctctatagagacaattaaaggcaccctccagacaggcaaaaatactataggcatcatagcccataatttctgcaataacatcaagatagacctgttgttacactgggaacagtaagtaaagtagaaattttgcaggcattcccaggactggggttaagcagaagtcaacatggaagattaacatccaagatggggtcatttttctctccacatctgaaaatgttaaacatgttgctgagtgatatggtttgggtctgtgtccctgcccaaatctcatgtcaaatcataatccccaatgttggaggaggggactgttggaggtgattggatcatgggggcagacttcccccttgctgttctcatgatagtgaatgagttctcatgagatcatgttgttcaacagtgtgtagcacctgccccttccctctcctccccctgctctggtcatgtaagacgtgcctccttcctctccaccttctaccatgattgtaagtttcctgaggcctctccagccatgcttcctgtgcagcctgcagaactgtgagccaattaaatctgttttctttataaattacccagtgtccagtagttctttatagcagtgttacaacgactaatttagtgaatataaaatattacattctccttaatttctaaatgcttctaactctttaaagtaaaaattataacattgtattgtgggagttttaatgtttttatacattatatatgaaaatacagcataaaggttgggggtaaactgatgtgtatagttgtaaggctcttaaattttgtgtgaagtggtaaaatatttatatctacgtagaatgtagactctaagctaagaatgaatattgtaatcactaagcaaccactttaaaacatagaaagaggtgtagctagaatgccaattaacaaattaaaatggagttccaaaaatttattttaacccataagaaggccaaaaaggatgaagagaggaaaaatgtatatacaaaacaaacaagtaataaaatggtagatctatatcaaattatgtccataattacattatctgtaaatggactaaacactccagcgaaaaagcagagaaggcaggattaaaaaacaataacaaggagaatctatatccaactacaagagatacactttaaatgttacaatacagatagctgaaaggaaagagatgagaaaagatacattatacagcatccaatcagggcataagaaagctagaataagggctaggttaatttcaaatggagtagactttaagacagagataaaaagggacatttcatggtggtaaaatggtccattttcatcaagagaacaaaaatcagaattgcatctaacgatagagcttaaaaatgcatgaaacaaaaattgacaaaacctggactcccagttacaaaatcgcagtgcagaagcaagctggtttcactccccaccccccacagaaaaccaaaaacaaatatatagcaccaagattatcaccagcaatataccataactcaaatatgaggatgagacagttcctgggactacagagaagtgaaaaaactctgagccgacagtcagaggatcagacttccatatccataatgctctgccctccgatctgcccagcaccaaacacatggaaatcttccccctgactcacagcttctacactggaaacactaagattgaggcgtttgatctatttccccaccatcctgcgttctttggcaggagacctgcctctgccccaagtcacaggaagcattgagagtgcctagaaagagaaatgcccctaaggacagtcagagacaaatggcaaaggtgggacttactatccccagcttagaaaactctgctctggacgttggccaaaggagataccaaatcagagtggctgttcatcatcaccacacgggaggaggttcgtttcacaggttccctgttcgcaaacccctggaaagcttcccacgctgccaggctatcccttttggagcctcacccgtttgggaacaggcagcaatctgatttactacaactgaggcaaacttgagcttaaggcgccatctagtgccaaaaaggaggcagtgatctagagggaaaaacaaaagaaacataattaacaggtaaattacaaagactctctaagcaaacatatcccccaaaaaaccaaaacaagccagacagggaagtctggaataaataactaatcctttaatgcagagaaatagacatccatgcacaagaaacaacagcaaacaggcagctgcgtgtggtggagcacacatgcagtcccagctactcaggagcctgagcctgagaccaggagttcaaggccaccttgaactaagaatacattactgcactccagcctgggtgacagaacaagaccctctgtctcaaaaaaaaaaaaaaatctctcctcgccaaaaaaaaaaaaaaaaaaaaaacccaggactagatggattcacagcccaattccaccagatgtgcaaagaagaactagtaccaatcctactgaagctactccaaaaaacggaaggggggaatacaccctaactcattctacaaagttattgtcaccctgataccaaagccaggcaaggacacaacaacaacaaaaaagaaaactacagatcaatatccctgatggacatagacacaaaattccttcacaaaatattagcaaaccaaattcaacagcacatcaaaaagataatgcaccaagagcaagtgggttttattgcaggaatgcgaagatggttcaacatatgcaaatcaataaatgtgactaaccacataaacaggattaaaaacaaaaaccagattattatgtcaataaatacagaaaaagtatttgataagagtcatcagtccttcatgataaaaaccctcaacaaactagacatagaagaaacatacctcaaaataataaaagccatgtaaaacaaacccacagccaacattatactgaatggggaaatgttccctctaagaactgaaacaagacaaggatgcctactttcacactcttattcaacatctggatttcctagccagagcaggcaagagaaataagaggcatcaaaactggaaaataggaaatcaaagtatctgtttgccaatgatatgatcttatgcctagaaaaccctaaagactcctccaagacattcctaggtttgataaatgaattcagtgacgttttaggatacaaaagcaacatataaaagccagtagcatttctatataccaatagtgatcaagcagagaacaaaatcaagaagtcaatcccatttacaataactagaaaacaatactaaggaatattttactaaagaggtgaaatatctctatctctattaaaaaactataaaacactgatgaaagaaattatagatgacacaagcaaatagaaaaaatagcccatgctcatggattggaagaatcagtatcattaaaattaccatactgctcgaagcaatcaacagacttaatgcaattcctatcaaaataccaaggtcatttttcacagaattagaataaacaatgttaaaattcatatgaacccaaaaaagagtccaaatagccaaagcaatcctaagcaacaaataacactgtctgactttaaattatacaaccaggctacagcaaccaaaacagcatggtactggcataaaaatagatacatagaccagtggaacagaaaagagaacccagaaataaagccacatacctaatgataattgatcttcaacagagtcaacaaaaacgtacactgaggaaaggacaccttattccgaaaatggtgctggaaaaattagatagccataagcaggagaatgaaattggtcccatatctctcaccatagacaaaaattaactcaagacagattaaaggcttaaatgtaagacccgaaactataaaaattctagaaggaaacctagaaaaaaattattctggatattggcctaggcaaagaatttataaccaagacctcaaaagcatatgcgacagaaacaaaaatagacaaatggaattatatcaagctaaaaatattctgcacatcaaaagaaacaatcaacagaggctgggcacattggctcacacctgtaatcccagcactttgggaggctgaggtggacagatcatgaggtcaggagttccagaccagcctggccaacatagtgaaaccccgtctctactaaaaatacaaaaattagcagggtgtggtggcatgcacctgtagtcccagctactcaggaggctgaggcaggagaattgcttgaacccgggaggcagaggttgcagtgagccgagaccatgccattgcactctagcctgggtgacaaagagagactctgtctcaaataaaaaattttaaaaaaaagaaaagaaaaagaaacaaccaacagaatggtcaaactatggaatgggagaagttatttgcaaactatgcatccaacaaaggactaatatccagaatctacaaggacctcaaataactcaacagcaacaaaataaccccattaaaaagtgtgtgaaagatatgaacagatactttttaaaagaagacatacaggttgagcacagtggctcatgcctgtaatcccagcactttgggaggccaaggcaggaggatcacttgagcccagaagttcaagaccagcctgagcaacatggccagagcttgtgactacaaaaatagctgggtgtggtgggtgcacacctatggtcccacccatttgggaggctaaggtgggaagatcacttgagcccaggagatcaaggctgcagtgagccatgattgcaacactgcactctagcctgagtgatagagcaagatcttgtctcaaaaaataaattcctagttcggctgaccaagaaaagaaccaaaattatcaatatcgggaatgaaaaaggaaacagtcttacaagtcctatagacattaaaagaataataactgcatattataaataactttatgctaaaaatatattcagaaaacctagataaaataaattccttggaagtacagcttaccaaaagttatataaaataaaatagaaaatctaaatagtccatgtatctcataagaaattgaattcataattctgaaacttcccacacacacacacaaatcttcccacagagaaaattccatgtggtttcaccagtaagttttattaaggcggaattgaggccaagcatggtggctcacgcctgtgatcccaacactttgggaggccaaggcaggtgaatcacctgaggtcgggagttcaagatcagctggccaacatgataaaacctcatctctactaaaaatacaaaaattagccaggggtggtggcacatgtctgtaatcccagctactcgggaggctgagacaggagaattgcttgtagccaggaggtggaggttgcagtgagccaagattgcaccactgcactccagcttgggcaacagagtgagactgtgtctcaccaaaaaaaaaaaaaaaaaaaaaaaaaaaaaaagaaggaattgacacacacactcacaaactcacaaaatggaaagaacacttaacaactcatcttatgaggccagcagaatcctgaggacaaacctaacaaagaaatcacatacacacacacgaaaaaaattccagaccaatattctttttgaacattaatgcaaaactccttcacaaaatatcacaaatagaatccagcaatatttaaaaaaaaaaaagaaagaaagaaacatgaccaaattggacatatctcaggaatccaaggttgatttaactcacaaaaagccaaacaatgtaatcagccatattaacagtctgaaacaaaaattactcattgaaataaagcaggaaaaccatttaaaaaaaaaacagccagttattcaaaaacaaaacaaaaaaggaaataacttttagcaaaccagaattaaaagggaacttctgcaatctaattaatgacatcttcaaaaagcctacagttaacactatacttagtagtttaattttttttttttaattaagacaggatctggctctgccacccaggctggagtgcagtggcgcaatcacagctcactgcagcctcaacctcctaggctagagtgatcctcccacctctgcctcccaagcagctaggactataggcatgtgccaccacacccagttaatttttttattttttgtagagacagggtttcgttattttgtccaggctggtctcaaactcctgggctcaagcgatcctcccacctgggcctctcaaagtgctgggattacaggtgtgagccaccacgcccagcagtagttgaatattgaatagttcccctctaagattgggaagaaggcaagaatatccattttcaccacttctgttcaacatggtatcacagattctagcccgtgaggtaaggcaagtaaagaagtaaatggcattgggattggaaagaaagaagtaaattatctttattcacaagtgaaattattgtttacatagaaaatcttaaggaatctataaaacatctgctggaactaatacgtaaactagcaaacttgtagacacaaaggcaatacaccaaaatcaattgtatttttctgttctggcagtgaaacattagaaaatggaattagaaaaccaattttatttactggaatgccaaaaacatgaaatacttaggaataaatttaacaaaagacattgcctttacatttaaaacctcttcattaaaaatgtctacattaaaaagcacacaatcttactgagagaaatttttaaagggctgaataaatggagagataaaccaaacgcactgattggaatattcaatgcttttaagacgtcaattagtcccaaaattgatctatacatttaatgtcatcccaaccgtaatccaatctgaccattttatggaatttgacaaactcgttctaaaatgtatataaaaatacaaagacctggaagtatccaaagtaatcttgaaaaagacaaatttggaggactactagaactggatttaaagacttgtgatgaagctacagtaatcaaggcattgtggttactgtcataaggatagataaatagatcaatggactagaacagagaatccagatgtagatcctcatttatagggtgatttatttatttttttataaaaacaccaaagcaatccaataaagaaaggaaatgtttttaggctgggtgcagtggctcacccctgtaatcccagcactttgggaggtcgaggctgggagatcatttgaggtcaggagttcgagaccagcctggccaatatgatgaaacccccatctctactaaaaatacaaaaattagccaggcatggtggcaggcacctatagtcccagctactcagaaggctgaggcagaagaatcgcttgaacccgggaggtggaggttgcggagctgagatcatgccactgtactgcagcctggacaacagagcaagactccgtctcagaaaaaaaaaagaaggaaggaaggaaggagagagagaaaaaaagaaagagagagagggatggaaggaaggaaggaaggaaggaaggaaggaaggaaggaaaagaggagaaagaaaggaaatgttttcaacaaatagtctgagaaaactggagattcaatatggaaaaaaaaaaagtgaccctctgcctacaagaaaagataggaaacttccttctcaacttggagaccaggcttcttaagcaggtttcttaggcagtactgagaaagcaataaccataaaagaaaaagtgtataaagtgtataaagtcattttatcaaaatgtgaaacttcagtttgtcaaaagacatctttaagagaatgaataggctgggtgcggtggcctgtaatcccagcactttgggaggctgaggcaggtggatcatctgaggtcaggaggtcaagaccagcctggccaacatggttaaaccccatctctacaaaaatacaaaaaattagctgggcgtggtggcgggtgcctgtaaccccagctacctgggaggctgaagcaggagaatcacttgtacctgggaggtggaggttgcagtgagccgcgatcgcaccattgcactccagcctgggtgacaagagtgaaactctgcctcaaaaaaaaaaaaaaaaaaaagaaaatgaatatgtcattctcagactaagaaaaaaattcacaaaacatatatatctgacaaaatgtcagtattcagaatatatttaaacacacacacacacaaacacacttctacaactcatttaaagaaagaaaaaaaaggaaagtggtgtcagtaagatggctgcctgcagaccctgctgttcaccctcccacaagacccgaccaaggcaagcaatacgcagatcagatttgactggagtgtggagggagagggctggagtgcagcaggggagtggagctgcagctgcggtgactgcaaggccaggagggctggacctccagcatgaaggcacctggcctctgcaaccccgcctcccccatctggatctgatctgtccagagtcagaaaggacatctcactgcaggggaaaaagtaagcagaagaaccccctcggaacccccattgcaactacaaacaccttcagtcctcactgctggagaatcccagagtcctcgagggccctgagtccagtgtggagagctacaggaggtcacacagccacactgccctggatccggagcacagttgcacactacccatccccatctaccccctcgagccaagctactgcagcacagccccatcttgagaccagagccatttctagagtgcaccctgctctgagggccagtagccactacccctctccagcaccgggcttcagcattccaccaagcccacgcgggtggctgctgatgcaagcgcagtaacataaagcctgggggcaggactggctgtgactggccctgcacagcagggaaaccaactcctgtgaccctcacctccagcaggaggaacagtctggaagtcctgcccagggcaaacctgcccttgagccagccaaactgctgcgtgcccaagcaggagaggccctcaagcctccaaacagctgaaacactcctgggctggcagagcagctatgtgcctgtgcccaagtcccgagaaactgtctgcaatgctcaatcccctacagacaagcccctggcctgcccagtggccctgcacccacaatcaaggcctgaaaaacatccctgcaggctacctctggcagacactcccctaggccagccaagcaactgtgtgcccatgccctgcaactgagaaacaaccctacaggtgatccctgttggacaaaaccccaggctggccaaaccgccatgagcccatatcccaggcctgagaaacagccccatgggcttcccccagcacacatgccccaggccagccaagcaactgtgtgaccataactaggtccaagaaacagctatatgggcagccccggtgggcaccctccaggccaactgagtagccttgtggctgcatcccaggcctgagaaacagccccacagtctgcccctggcatgcatgcccccaagcctgcagagcagctgtaagcctgtgtcctgggcctgagaaacagccctgcagactgctcctggcaggcacagccccaggccggccatgcaaccacatgcacacattcccaactagagtaatagcctcttagcgccaaccccagcctcacgtttgccaacacacaatgtgcatgcatgcacctctgacctgaagaagcagcctggcaaggctacccccggtaaagccacaccactgccaccacagcctctgttagcctaagccactgagacacttggaaatgtcactagagtggcttatagctgaagaaactacatggaaactacagtactttgtattttatttatttatttatttgtttgtttgttttttatttttgagacgggatcttgctgtgttgcccagtctggagtgcagtggtgtgatctcggctcactgcaacctctgcctcccgggttcaagcgattctcccgcctcagcctccccagtagctgggactacaggtgcccgccaccatgcccagctaatttttgctggaaactacaatactgcagccccctaaaaccaaagccagtactctccaccaaaacaacaccccatgtatattttttgtaagtgttgtgactttataatacacagataatatttaaccttccccaccccagtcatttttttctcatatatttcaaggtctttctctcacaatgatccttccagataaacttttttttttttgagatagggtcttgctctcttgcccagcctgaagtgcaatggcacaatctcagctcactgcagctttgaactcctaggcccaagcaatcttctcacctcagcctcctgagtagctgggactataggcacatgccaccatgcctggctaattttttttaattttaatagtttttggggtacaggtggcttttggttatatggatgaattctttagtggtgaatggtgagatcttagtgcactcatcaccagaacagtgaacaccatacccaacatgtagtctttcacccaccttccagtctccccgactgagtccccagagtccattatatcactctgtatgtctttgcatcctcatagcttagctcccacttataagtaagaacatacagtatttggttttccatttcagagttactttgaataatggcccccagctccatccaagttgctgcaaaatgcattattttgctccttattatggctgagtggtattttatactgtatatgtaacattttctttattcactccttcctcggtgggtacctaggttgattccacatctttgctattgcaaattgtgctgctacaaacatgtgtgcatgtgtctttttcatataatgacttcttttcctttacatgccatgtatattaacaacactttccctataaaacctactccctaaaattggaagaagcaacttttccatcaaatgcatagaaatcaatgtagggacacatcaaacatgaacaatcaaggactcatggcacctccaaaggaacacagtagctctccagtaacagtccccaatcataaggaaatataaaaaatgccagaaaaagaattcaaaataataatctgaagaaaattcaatgagatacgatagaatacagatatacaattcaatgagatcaagaaaacaattcatggtctgaatgagaaattcaacaaagagatagatatcataaaaaagaacctaacagatattctacagctgaagaacttaatgaatgaaataaaaaatatatttgagagcttcaacaacacaccagaccaaacagaagaaagaatttctgagctttaagacaggtcatttgaaataatacaggcagaccaaaagaaagaaaaagagaaaaggaaggaaggaaggaaggaaggaggagaaggaaggaagaaagaaagaaaaataaagagggagagggagagacagagaaagaaagagaaagaaagaaagaagagacagaaaagaaggagaaaaaaagggagggggagagagaggaaagaaaagaaagaaaggaaagaaagaaagaaggaaagagagagaaagaaaggaaggaaggaggaagggagggaggggaagaaaggcagaaacaaaggaaagaaaaagaaagaaggagagggagagacaaagaaagagagaaaaagaaagagaggggagagagaaaagaaagaaagatgaaaagaaaggggggagagagaggaaagagaaaaaaaagaaagagagagagagagaggcagggagggaggaaggaaggaaggaaggaaggaagaaagaaagaaagaaagaaagaaagaaagaaagaaagaaagaaagaaaaaagagaagagaaaaaagaaaagaataattaaaaagtggctgggtgctatggctcacacccacaatccagcactttgggaggccaagataggaggaccacttgagtccaggagtttgagaccagcctgggaagcatagtaaggccccatctctaccaataaaagggttttttttaattggcttggcatgttggtgcatgcctgtaatattggctccttgggaggctaatgcaggaggatcacctgagacaaggaagtcaaggctgcagtgagccacagtcatggcactgcattcctgcctggacaacagagcaagactttgtctcaaggaaaaaaaaatgaagaaagcctacacaacttatgtgacattattaagtaaagaaatactcacattatgggtattccagaaggagaagataagggaaaaggtttagaaagcatatttaataaaataatagctgaaaactcaagtctttggaaagagatggacatccaagaagatcaaataaccctaaatggattcaacccaaacaggtcctctctaaggcacattatactcaaattgtcaaaagtcaaaaacaaagaaagacttctaaaagcagcaagagaaaagcattaagtcatatataaaggaatctctattagactaacagtggatttctcagcagaaaccttacaggtcatgagagaatgggatgatatatttaaagtacggaaagaaggccaggcatggttgctcacacctgtaagcacagtattttaggaggccaaggcaggcagattgcttcagcccatgagttcaagagcagtccgggcaacatagcaagactccatctctacaaaaatagaaaaattagccaggcatggtggtatatgcctgtagtcccagctactcaggaggctgaggtggaaggatcacctgagcctgagggggctgaggctgcagtgagctgtgatcacaccactgcactccagcctgggtgacagagtgagaccctgttcaaaaaaaaaaaatagtactgaagaaaaaaaaaaaaaaaaaactaccaagccagaatattatacccagcaaagctatccttcaaaaatgaaggaaaaataaaatctttcacacacaagcaaaaactaataggccttacaagaaatactcaaaggagttttacacctggaagtgaaaagacaacaggcatcatcatgaaagcatgtaaaactataaaacccattgttaagagctgatgcacaaaggagaaagagaaaatcatcaaaccttatcaaacaaactatgcaaaacgactcaaacacaaaaataatgagaggaagtaaggaacaaacaatagataaaacaacaaggaaacaatcaataaaatgacaggaataagtcctcacctatcaatgataactttgaatgtaaataaactaaattccccccatttaaagatatagactgaatggatttaaaaaaaaaaaaagaccaactacacattacctataagaatctcgccttacctgtaaagacacacataggctgaaactgaagagacgaaaaaagatattccaagcaaaccaaaaccaaaagcaagcaggagtagctatgcttacgatatggtttggctgtgtccccacccaaatctcatcttgaattgtaactcccacaattctcacatgttgtgggaggaacctggtgggaggtaattgaatcatgggggcaggtctttcccgtgctgtttttgtgatagtgaataagtgtcatgaggtctgatggttttaaaaacgggagtttccatgcacaagctctctctttgcctgctgccatccatgtaagacatgaattgctcctccttgccttccgccatgattgtcaggcttccctagccacgtggaactataagtccattaaacctctttcttttgtaaatttcccagtcttgggtatgtctttatcagcagcgtgaaaacggactaatgcaactatgtcaaacaaaacagacttcaagtaaaaagctgtaaaaggagacaaggaaattatataataataaagggattaattcagccagagaatataacaattgtaaatatatatgcacccaacaccagagcacccagatatataaggcaaatattagatccaaagggagaaatggaccccgatacagtaatacctgggaacttcaatgtcccactgtcagcattggccagatcatgtggacagaaaatcaacaaagaaacatctaatttaaactgtaacacaggccaggcatggtggctcatgcctgtaatcccagcactttgggaggctgaggcaggcggatcacttgaggtcaggagtttgagaccagccgggccaacatggtaaaaccctatctctactaaaaatacaaaaatcagccaggtgtggtggcatacacctgtagtccctgctacttgggaggctgaggtgggagaatcgcttgaaactgggaggcggaggttgcagtgaactgaggttgtgccactgcactccagcctaggtgacagagcgagactctgcctcaaaaataaaaataaacaaaaaataaataaactgcatcatagaccaaatggacttaacagacattttacccaacatatgcagaatacacattctgtttatcagcacatgaaacattctccatgactgaccatacattaggacataaaacaagtctcaaaaaaaactttttagctgaaattctactaagcattttatctgaccacaatgaaataaaactggatatcaataacgagaggaacatttaaaaccatacaaatgaatggaagtcaaacaacatgctcccgaatgaccaatgggtgatgacagaaattaataatgaaatttaataggtcaggcatgatggcttacacctgtaatcccagtcctttgggaggccaaggcaggaggactgcttgagctcaggagtataagaccagcctgggcaacatgatgaaatcctgtctctactaaaaatacaaaaagtagccacttgggcccaggaagcagaggttgcagtatgttgagatggcgccactgcactccagcctgggtgacagaacgtgaccctgtctgccccccactcctccaaaaaaaggatgaaatcctgtcattcgcagcaacatggatggaactggagaatattatgttaaatgaaataagccaggggaacagaaggttaaacactgcatgttctcactcatatgtggaagctttaaaaaaaaaaaaaagtttatctcatagaagtaaaaagtagaacagagaatactcgagattgggaaggatgggggaaggtggggttagggagatatttgttaaaggatacaaaattacagctagataggaggagtaagttctaatgctctacagcactgtaggatgactgtaattagcaataatactgtatatagtttcacacagctagaaggaggatagtgaatgttccaacacaaagaaatgacaaacgtttgagatgatggatgtgctaattaccctgatctgatcactatatattatatgtatcacaacaccgctatgtactcatatatatgcacaattattatgtgtcactttaaaaaatgtttttaactgttttcctctatgggctgcttagctctacagatatacaccaggagtcttcaatctaagctaactgggaaggggaacagggaacaggaaacagggagaagaaacggtctgatgaaactcaccttcccatcatttggcagccagaagaagaggagcaggtggagactgtaatggggactgctagtattgccttttctgtctttttgttattgatcctattggccaaattaggtacacacaggtatcagcattgctgcttttcttctgatccttgcaggaaagtcagatgtccgtctcaaactgagcatcatcctaaactgcgtgttccctgtcatgattgttcaagttgtttacttctacttaggagtcttctattgaagtgccagggctagtgactcctgggatatcgggcagatggcagggctgtgtgtgagccatgggagaactgcaatgatccaacagaaacttttgatcataaatgattcaagatccctggggtgtggtgaagagcatcctccgggcatggtgcaatagccatgaggtagctgcacatgtcgctgatgggcacagtgtgggtggggatggcacagcactggctgggctggtgactgctgccagcagacaaggacttggctctgggtgcaggcactccgcttcatcctgaggacaggctgtggcggctgcagagctgggctgctccacctcctcaggcaggaggaaggctaaaaatgttttgtgttttttgtggttttattgttgtggttgttgttgttgttgtttttgatacagagtcttactctgttgcccacgctggagtgcagtagcatgatctgggctcactacagtcttgacttcccgggctcaagcaatcctcacacctcagcctcccaggtagtcgggactacaagcgtgcaccatcacacctcgctaatttttctattttttgtagagacagggtttcaccatgttgcccaggctggtcttgaactcctgggctcaagcaatcctctcacctcagtctttcaaagtgctgggattataggtgtgagccaccatgcccagcctggtcttttttaatttaattttgctttattaaggttttttttaggctaggcacagtggctcacacctgtaatcccaacattttgggagactgaggcgggcagatcacctgaggtcaggagtttgagaccagcctggccaacatggtgaaatcatatctctactaaaaacatgaaaattagctgggcgtggtggtgggcgcctgtaatcccagccactcaggaggctgagacagcagaatcttttgtgtccaggaggtggacattgcagtgagccaagactgtgctactgcactccagcctgggcgacagagcaagaccccatctcaaaaaagatcagcccattaaaaatgagtaaaagaccttaacgaacactttacacaagaaaatgcggaaatggcccttatgcacatgaaaaaagcttcatccttcattagtcaccagggaaaaacaaattaaaatcacattgggatacctctacatatttaccaaatggctacatttaaaaactaacaacatcaattattgttaagaatgtagtgtaactagaactcacacattgttgaggggagtgtaaaatggtacaatcactttaggaaaaaaatctgacggtgtcataaaactaaacatacacctggcctgtgacctgcaattctactcctagatatttactcaagagaaaggaaaacatgcccacaaaaaggctagcatgcaagtgttcatagcagctttattcgtaataatcaaaagccaaaaacagatcagaagaatggataaacacactgtggtgtattcataaaatagaatatggttgagcactaaaaagccacaaacaacaatatgaataaacctcaaaaacattacacgtagtcaaagagccttactaaaaagcatatatggccgggcgcagtggctcatgcctgtaatcccagcactttgggaggccaaggtgggcagatcacctgagatcaggagtttgagaccagcctggccaacatggcaaaaccccgtctctactaaaaatacaaaaattagccaggcgtggtggcaggcacctgtaatcccagctactcaggaggctgaggcagggagaatcgcttgaacccgggaggcggaggttgcagtgagccaagatcgcgccattgcactccagccttggcgacagagcaagactctgtctcaaaaaaaaaaaaaaaaaaaaaaaaaaaaaaaaaaaagcatatacactatacgatttcatttacatgaaattccagaacagcaaaattaatatatcatgaaaaaatcagaacagtggttgctttggggagtggggtagggatcgattgaggagaggcttgagagaactttctggagttgatgttactgtcctataacttaactgggatttgggactcgtaagtgtttgcctttgtccgagcttgttgaaaggtacacttaagatttgtgcaattcactttatataaattatatctgaaaaatacctgtaaacaaatgttgagctgaagttatgcaggtcaaggtgtttagaggtagaatatgctgatgtctacaacttacactgaaatgtgccaaaaaataagatggattgataagtgaaaagatgaatggctagataaatggatagatgattaagcaaagacagcaaggtgataagtatatcagtgttaaaatgtgcgattctttcaacttatccatatatttgaaagtttctataataaaactgtaggggaaaatatatatatactcttcaacccagaaattttactcctgggaatttatcccatagaaataaaagtatttgtctataataacacgtgtgagaacatttattgcaatgctgttcctagtgaccaagaactggaaccaaagtgcatatccatgaaatgggggtggatatgagtactcacctgagtagagcgtggcacgtccacaccatgggctagaacgtggccgctaaaaggagtaagtcagagcctctccagagagtttaaagggatttcactgaggaacggttgagggagaaaagcaagagtgaataatataatcctatttttgtaaaacaatcacacacaccacacatacactctctctctcttgttctctctctctggatagaattatatatatttaaaaaaatggaagaacacagattgctaacacagcttatgggtaaaggcaaaaaataaagggttgagtgttgttatgggggtaagggggaatatccatgatttaaaaaacagcacgtatatcatctcctttaagttaaattttctggccagacacactcaggagttcaagacgagcctggacaacatagcgagaccctagtctcaacaacaacaaaaaattagtttggtgtcgtggtgcatgcctctagtcctagctacttggaaagctgagatgggaggatggcttgagcccaggaatttgaggcttcagtgagctgtgattgcaccactgcactccagcctgggcaacagagcaagaccctgtctctttaaaagataaataaataaaattaaaataagttaaattttctgtagtatgcagcgtgtggtgcttaaagagatgcacatgaaggctgggcaccaaaatgttaataatggtcatctcatggtggtaggattccaggtaattatttccttgtctttgtaggaaggaagggagaaagggagggagggagagagggaggaagaaaacaagtctacaggtctcatatccttacctcctattatctcttcaacccaccccaactcctactgggtttttttgttttttgttttgagacaggatctcactctgttgtccatactggagtgcagtggtgccatcacaagtcaccgcatcctccatctcccagactcaagccatcctcccacctcagcctcccaagtagctgggaccacaggcatgtgacactgcgcctcaatattttttttattttttgtagagacgaggtctcaatatgttgcccaggctggtctagaactcctggcctcaactcccaattcctacttttgccagaccctaatcttatctgacctctcaccagcatttcgcattgttggcagatgtctccttgaaatactcccttcaatcaacttccatggcaccctgctcccaaatcctgcctctgcgatcatcacttctcagtcctctttccatccctcccatcatcttcctctggattttgtcctcaaacctgtccttttctcagtttaattaccatctagatgctaatgtctcccaagctgctgtcttgaactccaaccaaacatctctaattggatgtcccacaggtcatcagacccagcatggccaaaactaatctcatcatctttcccccaaaagctactgcttcttctcctgcagtccaatctcagagaatgtcagcatcgccacccaccacttgctaaagccataatcttggatatcattactctctcctactcccacatccagtcgctcaccaggtgctgtcagttctgtctcccaagtctctatccatccatcctcttgtctgcatctcccctacccctgctttgatttgggcaccattacatctcttgtaaatgactgaagcagcctgttcattcatctttctgtccactgcccccatttatctcccatagatgccagagagatttttctaaaccacagatctgacctcatcacttccctgtttaaacctctttgaggatttcccattgctcttaagatcaaggtcaaactcttagaaagagaaagaaagaaagaaagaaagagagagagagagaaagaaggaaggaaggaaggaaggaaggaaggaaggaaggaaggaaggaaggaaggaaggaaggaaagaaaaaaaaaaagaaagaaagaggccgggcgcggtggctcacgcctgtaatcccagcactttgggaggccgaggagggcagatcacgaggtcaggagatccagaccatcctggctaacacggtgaaaccccgtctctactaaaaatacaaaaaattagctgggcatcatggtgggtgcctgtagtcccagctactcgggaggctgaggcaggagaatggcgtgaacccgggaggcggagcttgcagtgagcggagatcgcgccgctgcactccagcctgggcgacagagcacgagtccgtctcaaaaaaagaaaaaaaagaaagaaaagaaaagaaattggccgggcttggtggctcacgcctgtaatcccaaaactttgggaggccgaggtgggcagatcacctgaggtcaggaatttgagaccagcctgaccaacatggagaaaccccgtctctactaaaaatataaaaaattagccgggcgtggtggcgggtgtctgtaatcccagctactcaggaggctgaggcaggagaatctcctgaacccgggaagctgaggttgcagtgagccgagactgcatcactgcattccagctgggagacagaaagactccatctcaaaaaaaaaacaaaacaaatatatatataactttttttttgacagggactccctctgtcgcacagactggagtgcagtggtgctatcacagctcaccgcagcctccatctcccggcctcaaatgatcctcctgcctcagcctcctgagtagctggaaccacaggcacaggccaccccacccagctaattttctgttttgtttttagtagagatgaggtttcactacgttgcccaggctggtctcaaactcctggcctaaagcaatcctcccatctcagcctaccaaggtgctaggatgatagacatgacccactgcaccaggccaagatcaaacccttaaacatgacacattggtttaaagatatgctcagcctcccccagcacatgccatctccagcccctggcctctctctttaccacaaatctaagaagcaagaacactgctgtgggccctcttcaagggctaggggcgctggaacatttggcagaggtgaggatgccttttcctttttggaaaactactttccaggtggctgaagaagtgagagggctgaggttgcttcccctagggcgacagccttccatctcccactcatccctctgactctattattctcaagaggttggggcaatgagctgggtggagatgactgaccacagagaagaaaagcccagagcggggataaagcccacttttcttttgctttagggagaaggttctgcactgatccacattcgcagtgccctcccttttttttaattttttttttttggagacggagtttcgctctcgttgctggagtgcaacggtgcgatcttagctcaccacaacctccgcctccctgtgattctcctgctcagcctcccgagtagctgggattacaggcatgtaccaccacgcccagctaattttgtatttttagtagagatggggtttctccatgttagtcagaacggtctggaactcccaacctcaggtgatccacctgcctcggcctcccaaagtgctgggattataggcatgagccaccgtgcccagccacccttctttttttgttttttttttagagacagtcttgctatgtcacccaggttggagtacaatggctccatcatagctcattgcagcctctaactcttgcacttaagcgatcctcccctatcagcctcctgagtagctgggactagaggtgcatgccactgcacccagctctccattctaattattaataccttgatatagagctcaggaccaaggcgggagggctcctctgctactgactgtcctccatacatacacagcatagcactgggcacaataactctttattttaatctttatcagtggagtctacagtacactgttcccctcggcttcaagctcccaagccagaaggtgagtcttactaaagaaaaaattactcacgacacttgttaaagacaataaggcaaacttttttgaagaggagacatgactgtaagtatagggaccactggaatggggtcctgcagcgagggagagagactggactcaactctgactgcaaccagttcaagtagagatttatcgccaaggagcagggagaggagctcaacagaatttttgctgaaggcaggccagggtgataagatactgaaggtggggagtttttgctaaactgacttagcaggattcttgctcacattggattctatgaggatagagagaagctcaagctcagggctagatgagcagagggctcagaggagcccagtgatagttttggtctaagaagagagtctttgtcagcctcaataggcagaacttaactaagtagggagaaaggagaatgtgaggctgcaggctggtcagagggcaccctctggtcagggtgccccattaaagtagccaaacactggctttggggtccacctatgggttttaagtcctaggcctgaagtaagaggcaggacttgactctggaggcagggctcggacaccaggcagaattgagcactagctaaaacagggatggggtggaagcagctttccttaagacacacccaccagggtgccatgtttaccgttgccatggcaacacctgaaagttaccaccctttgccatggcaatgacccagcgagccaaaagttactaccccttccctagaaatttctgtataaaccgcccattcacctacatgtgattaaaaatagctataaatataactgcaaaactgccctgagctgctactctttgcatatacggtagccctgctgtgcaggagcagtcacggagctgtaatcagccctgcacattactcactctgtaaccttaggcctcagtctccccatgggtgaagacaaggagacagagggggctagagttcctgtgtgtactcagggttctaggcgctggtgcccgctttccagaaggtcccagctggaatgtttcctaaaaaacaagagccaaatgtctcttgcttcacttcggcaactttcacatttacatataaattgatacctaatggttctgccctcctttatcttagccccaggttctaatgagctggaaaaatggtcctgtgcctgggaataacagagcttccaggctaagggtgggagagaataagtttcttcgcttgctgtgccatggggaaggcagagagggcaggggtgaagggaataccatgtcccttctccactgggacctatgccacagtgtcctaaagtaggggaaaaaagcgttttgtaacagtatgaaacatggtggaaaatcaagcctgaaagtatgtgaaatccactacacattttgtgaaaagtgactcataattctatttgttctttccggtgtacacattacagatatttcatccagacagaaactggaaataaagataagccaggagcgccatctgggacgtgatctgtcactaaggctaaggcttaaccgctcaaatccagagatctctgcagataccggggatggggagaaaagtgataaagtccctcccccaaaacacgcacaaacacacacacaaacacacacacacataaacacacacacaaacacacacacacacacacaaacacacactctactggtgccaggtccctcttaaagcgctttaaatacatccgcttatttaattccaacaacctgtgaagttaagagtcccattttagagactgaggaaactaagacttgctcacctaagtgactggcagacttgggcttcaaacccaggcctgtctgatcctaaaagcccaggttaatttacacaataccactacagcactagagcttgtctttcttttcttctttctttctctttctttatttctctttctcccttccttcctttttttttgtagagacagggtttcactatgttgcctagggtggtcttcttaaactcctgaactcaagtgatcctcccacctcagcctccctaagttctgattgtacagacatgagccactgtgcaaggcctaaagcagaagttcttaactgaggtccatggacagaattcagggagtccgtggatgaaaaacgaaactatatctttattttttcctatttctaactcaaatttaacatttccttcaaatctgaaagggggcaacaaaccaatatcattaactttgcctccagtggaaatcactgattttcatatcatattacagttgttgatatctcaaaatatcatttatggtcatcaatatttcaaaatatcagtagttaactgactcaccacaagatcttgtcatttagtgcattaataaagaaacactatggtagccaggtagctcccagaaaataaagccctgctatgtagcatttgccaattcccatggtgtaaatactcctacaattgcccatttcaaggatggctatgtttaacaactggtttgcaaatttcctgaaaatttagcaatcaatgtttggaagcacagacaagacagcttcagcacaccatgggcactagagtgaatttttctggatctgccagaattccctgcaagtcctgcagccttcaatgtaatgacattggtaataatggtaatagattttaaatattgattaaatccttcttctgttcaaagcataataataagcacttaacatgacctatctcatttaaactaccaataatccaataaggcaggtattattggagtggtttaaaatgggggaaagaggaaaggaaaagttgtggttttgccccctggcgatgtctggcaatgtctggagacattcttgattgtcctaactgggtttgctactggcatctagtgggtagatgctgccaaacatccttcaatgtacaggacacacacactacctgagaaagaattatccagcccaaaatgtcagtagaactggggttgagaaattctttattactgttattccctttttaaaaattggaaaattgccacccattgagattaagttgtccaagttcacacagttttcatagagtcagttatgagtgaagactagttcttactccctgactctcccttaccagatgtaggaagagttgcttattacaaaggaagcaggctgggcacagtggttcacgcctgtaatcccagcactctgggaagctgaggcgggcagatcacttaggtcaggagttcaagaccagcctggccaacgtggcaaaacttcatctccactaaaaatacaaaaattagccaaatatggtggcatgagcctgtaatcccagctacttgggaggctgaggcaggagaatcacttgaacctgaaaggcagaggttgcagtgagccaagatcatgccattgcactccagcctgggcaacagagcgagactctgtctcaaaaaaaaaaaaaagaagaagaagaagaaagaaagacaggaaggagggaaggaaggaaggaaggagggaaggaaggaaggaaggagaaaagagagaaaaacaaaaagaaagaaagaaaaaagaaaggaaggaaggaaagaaagaaagagagaaagaaaaaaggaaaggaaaaaaggaggggaagggaataaggaggaaggaaggaacgaacgaaggaaggaaggatagagagagaagaaggaaaaagaaagaaagaaggaaggaagggaggaaagaaaggaggggaagggaagaaggaaggaaggagaaagaaaaagaaagaaagagcgagaaagaaagaagggagggaggaaggaaggaaggaaggtaggtgcctgctgggctggccatggcaatgtgagtccaggattggtctcaaggaggctcaggcatcacatgttgaaagatccaaccccagctgcttctaaagagtgagaaggggatgacagtgacactctgtctctaaataaataaataaataaataagtgaggggatttggccccagaaattattctcaaagtgagtcaatctgatggcccattgggctgtctgcaaaattcatttaggacaataaaatgaaaaggaacatggagatcactcattgcataaatacttattaagaacatactctgtgcctgcactcttctaggtggtggtggagtagtgaacagaagcaaaatagctcttgccctcatggagtgtacaagctggtgggggagtagaaaagcaaatgaagaagtgggttagaaaaagtacagttgtgatagatgctgtgaaggaaggaagtgcgtgaagtgctatagtaaataatctccgtagggtcctctttagagaggatagtcaggaagacttccctgaagaagggatatgtgagctaagatctgaaggatgcaaagccagccatgggaagagaagagaacaggcatcgacacagtgggaccagcagggcaggtgatgaggctctgagcagaataagtttgctgttttctagtcaccaaaaggaggttattgtggcctggttcactggctcatgcgtgtaatctcagcactctgggagcccagtgtgggaggattgcttgaggccaggggtttgagaccagcctgggcaacagagtgagacctcccacctctacaaaaaaggtaaaaattagccgtgcatggtggtatgtgcctgtagtcccagctactcaggaggctgaggagagaggattgcttgagcttgagttcaaggctgcagtgagctaggatcgagccactgctctccagcctgggcaacagagtaagaccccatctcaaaaaaaataaaataaaaagagagagagagagagattattgtgactggagcacaaggacagagggaaggggcaattcaggaccaaggtaaagaggtcagcagagaccatgccacactgagctttatagcactatgttccactcatctgcctgcgctcaggactcaaaataggtgtgacaaaaaggaagccccaggctataagggctgggcaggtgagtgtctaaggagggtgtattagtctgttctcacgctgctaataaagacatacctggccaggagcggtggctcacgcctgtcatcccagcactttgggaggccgaggtgggcagatcacttgaggtcaggagttcgagaccagcctggccaatatggtgaaaccccgtttctgctaaaaataaaaaaaaaatgaagacatatctgagactgggtaacttataaatgaaagaagtttaattgactcacagttccacatggctggggaggcctcacaatcatggcagaaggccaatgaagaataaagtcaggtctcacatggtggcaggcaatagagcttgcgcaggggaactcccatttataaaactatcagatctcatgagacttattcactatcaagagaacagtatgggggaaaccacccccatgattcaatcatctccacctggccctgcccttgacatgtggggattattacaattcaaggtgagatttgggtagggacacagccaaaccatatcagtgggtggtggggaggggtacttgtaggtacctagagggacttctagtctctcccgtgctcccacactcacctcccttaacccgtcacctctactgacccaagattcccaaatgccaggatccaagatgtgagtgtgtgtatgtatgtgtacaacaatgatgaagatcagatggcattggagaaatcctcagcacatgggactggaggaccaacatgcctggctctgtgctgagaatgtcacactaataattagtcatttgattagcagctgcccacttaaccactgcactgttcaacaacagtccaatggactggtgccctagagctggattaactttgcagagtgggtgaacaaactaagctctgctcagggaagcccagaattccagaacagtgagactcatctcagaaagcagagaatggcagaaggtggagaaagaggggaggaaacagaccctgagtaaattcactgtgccagctgctacgtgaagcttcactatacatgcattatctcatttcatccttccaacaatacacttcgggggtacccttttccctattctccactcggaaactgtattagatccagtcaagtccaggattggaatccaggtctcccttttccttggtgaagtgcccacccaatgtctggatttcaccgtcagtgattcaaggaacttctttatctattcagaattaaagaagtgagccgaggagccactggtgtgcccaagacaaagatggcctctgaaaggagagaaaatatagccccgatgaggggaggaaatgctaaacagaatttgccagaactctccagaaataatgaatgcccaggagaagagcaaaggtattgagaacttggggaaccatttgactgtgtaaagggggtaatatttttgaaactatcaaatagatccatctacttttcatccctgtgagtcatgatgctctgaatctcttctttccaccacccccagccccattaaatcaagaggaatgccgaccccacctgaaataaagaggccatcctttagctttgagtctgtacagaggccatagtcttaaaacctagcctggtggggaatacggagaggttcttaatttcaaaaacttccctttccatgcaaaggcaaatctgggaggtctgagctctggtatatattataagcagtcattagatggcattcagtaaaagagctcagaagaaggtgatctcttccaagcccagaagtggaaccaagaaggcagggagattcagagaaaatgcaaccaagagaaagacgttgcctggaacgctcagggattcagtgccccgacctccctcagcccttgccccagtatgggatggaaagaaaataggaatccagggctgggctcagtggctcacacctgtaatcccagcactttgagaggccgaggcgggaggatcacttgaggttgggagttcaagaccagcctgcccaacatgtgaaaccccatctctacaaaaaatataaaaattagccaggcatggcggtgcacacctttagtcccagctactcaggaggctgaggcaggagggtcgctttaaccagggaggtggagactgcagtgagccgagatcatgccactgcactccagcctaagcaacagagcaagattcagtctcgaaaaaacgaaaatagaaatcccagaaggtgagaggaaaaggagaaatcagaaagggtttttcttcattgaagctctgagactgtgcctctgggtgaccaaggagcagccaagatagcagagagatggtcgtagccttggaggatccatcaggggcagtcacaaaaacagagcctctacaagcactgtgggaatcagatttcatattggaacaagaactcacgcagatgtgggataacttagaggtggaaatcagagggccagacaaagagccactatcatgtctgctggagccactgatgtgagtggacacaccacagcttgcagggagaatccaagaagctcttcctgtctgcccaaaggaggccatgaatgaggtccttacagaggggttgtagcaatggagaataaaaaaaaaaaaaaaaaaaaagacaaatttgagagatgcttagaggtggaactgaaagtccagaaatggtatagcagggagaggggagggaaagggtggggggcaagggaaccctagatttttgacttgagcagctaagtggactgagcactgtgcagtaagatgggaaagatgggggagggagcagggtcaggactagagtgagcaagtgaggtactcacttcagacaccaaatataaggctgcgcctccaaaaaaaatcattaaaaaatataaataatgttttaatgtggtaatttttttaaaaaaaatcaaaatgaatgcaaaaaaaaatccatgaagaacaagatcagggttactgatttttccttttgcctcaggcttcaatatggctcagcacagcactatttctgatcctgtcttgattaaaatgtttaatcttttgctcaccatgggttttttttgcattcatttattcctttttaatactgcatcaaaatattatttgatggctgtgttttctggtgccacccacattttgcacctaggatgagagcttcactcacctccccatttccagcccagaggaagaagcctggggaaaggaggttaactaaggttcagtcttggatatacatggggattaaaatagatctcagggctgagcatggtggttcatgcctgtaatcccagcactttgggaggccgaggcgggcagattacctgagggtaggagttcgagaccagcctggccaacttggcaaaaccccgtcactaccaaaaatacaaaaattagctgggcatggtagcaggtgcctgtaatcccagctacttgggaggctgaagcaggagaattgcttgaacctgggagacggaggttgcagtgagccgagattgcgtcactgcactccagcctgcccctgggcaacagagcaagactcagttctcaaaataaataaataaataaataacctcaggtgtgaagtgcctggaccagagaggacctttaacctgtattgtagtggattctgtgggtacctggcttgttccctaggtctaaccatttcagggcacaacagctgccatcacctgcatttcctgcctcaggactctcttggccaccaaatgagagatactggaagtgctgggtaattaacagcccccccatccccatccccccacacacacacccccacacccccacccagcagccttctgaggcaggagaatggggtctggaggcagggaacctaaggccctttcaggctgactccctagaactaaattgaaagaaaaaccataactttccatacctaagtaaaaaaaggaccagagtctacaccctttgcaaacacccaccttttctgcggggcagatgggaaatgaaagtaccaagacgtttgcataggagtgtaactttgtgatttcacttcagcctctgattatgggccaccacttcatttacatgaggtgaacaccaagtggccaatgggaaacctctagcggatatttggaccagagaagattctgtatccagggcctgctcccacactgtagagtgtactttcattttaaatttctgcttttgttgcttcattctttccttgctttgtgcattttgtccaattctttgttcaagacgccaagaacctgaacaccctccacgagtaacacttcaactactgatccacaggagttggtgtataaataccccagctccctcgcccctcagatgggaccattttgagatatatatgttgcaccatttcccagagtccaggtgagatgaagctccagttgtccaaagtgtaactgattggataatatacccatatgctctgtcccttccccatctcaattctctcccctgttaatggcgtttcccagggtgacttcccaaaaccactgcatgcacttgaatccttgtctcagggcctgcttttaggacaactgaaccaagagacctatgcgtccttcctttttccccctcttctctgtggaaacatagaatgttctgcacacacttggaagtctgagcataccctctaaggagagacccctgactcccagcattcccctgggacggaggtctgtagggtggtaattgccagccagcgctaggaggactggatctgaaatgggcttggctgtgtttctgtaatctctgcaccttgagtggaaaaataattggtagacacctttcttggccattaattctttacagccaacactgagcccttgaggcaaaaactgattgtctgcagttactgcctgcctggtcctgaattcagaacaggaagcctgactctcccccaccctttattacagacaaccactcctccctcttgcagagatgagatgccctccctcacttcctcccagagtccaagaggggccagagaaggctggttgtacagattggaggagacataaatgcccctcaagccagaggaactaagggttgagagccatgagttaaaaatcatggaaggcatagcctttattcatgctttcttttttaaaaatatttttcatcatgcacactttttgcccattaatacccacacaacaacttatgcagtagatgttactcttaacacccattttatagatgaagaggctcagagaaaaagaggggcttagcccaggccacatagagaataaactgatttggacacaggtctgtctgactccaaacaccattctcttcttcatgctataggttgtttttctcccttcagtaaacgtttcttgagcacctacatgtcccacgccccatgctggcctgaaggaggacacaaagataggtaagaaccatttgttcccttcaggaggaagagataaaatctccccagttcttcccatttctgcccattccctatacagagggtcagcatttgcttgttgttttttgttttttgttttagacagtctcgatctgttgctcaggctgcagtggcatgatcttggctcactgcaacctccccctcccagttcaagtgattctcctgcctcagcctcctgggtagctgggactacagatgcctgccaccacgcctggctaatttttgtatttttagtagagacggagtttcaccattttggccaggctagtctcgaactcctgacctcatgtgatctgcccccctcagcctcccaaagtgctggggtcacaggcgtgagccaccacgcccactcagcatctatttttataagatgtatatattgcctatagcagctttaatgctacaaatttgagtaggtgtagcagagaccatgtggcccacaaagctgaaatattggctgcctggccctttacaggaaaagtttgccaactcctggtccacaccgtgccaggcactgacgatgcaccaccacacttacttctcaactcgactctggaaggtgtcctactacgatgtccatgctacagatgagaaatgaggctcagaggcaggagatggcttgtcccattgctggaaaggtacaaagttggataattccaaagcccaccacggctccaagccacataaaaaatgttgatggccaatgttttgaaacattagcattcactcttgaaagagctcacaaccggccagcgcagtagctcacgcctgtaatcccagcaccttgggaggccaaggtgggcagatcatgattttaggagatcaagaccatcctggctaatacggtgaaatcccatctgtactaaaaatacaaaaaattagccgggtttggtgggcaagcgcctgtagttccagctacttgggaggctgaggcaggagaatcgcttgaacccgggaggcagaggttgcagtgagccaagatgacaccactgcactccagcctgggtgagaaagcgagagtctgtctcaaaaaaaaaaaaaaaagaaagaaagagctcacaacctccattagcagtgggccactggactatccccatagtccccactccgcaaacacctacatctgccatgttgtcttagagagacctgaacctggtcaggtccccagtcctgcacgggtgcccttctcctacaggcaccagaagacctttcactgtggtgaacaggcattcatgagttcatccaaaatctgaggctggtgtcatgatcttctgttactcagtctttgtgggagggcaggttcacatctgaaggaggagctgaaagttggctggagtgcaccacatggcaaaagtggcccgtttatgagaagctccttaaacttggtctttttctctactcctgtgagacaggtaagatgcttaaatctacacttttttttttttttttaagagacaggttcttgctctcttgcccaggccggagtgcaataccacgatcctagctcactgcaggcttgaactcctgggatcaagcgatactcccacatagctgggactacaggtgcccgccaccatgcccagctattttttttttgtttgttcgtttgtttgtttttggtagagatgaggttgtgctgtatagcgcaagctggtctcaaactcctgggctcaagcaattctcccgccttggcctcccaaagtgctgggattagcagccctgagccaccacgcccaactatattacctagttctttttttttttttttttttttttttgagatggagtctcactctgtctcccaggctggagtgcagtggtgcaatctcggctcactgcaaacgccacctcccaggttcaagcgattctcctacttcagcctcccaagtagctagaattacaggcatgtgccaccacacccagctaatttttgtatttttagtagagatggggtttcgctatgttggtcaggctggtctcaaactcctgacctcaggtgatccgcccaccttggcctcccaaagtgctgggattacagccatgagccactgctcctgactacattaactagttcttatcaggagctgactgcctttagcatacacaatttgcactgttgtcctcccagcactcaccttcacaagccaaaggcttgctcgcaactcctacctcccagccctggggcttcttaatttctggctgtggaagaagattcagccaatcaagcaagcaggaaatgccagagtgaacactcctggaagcaagcttcaaccaagggcagctgggcagttaacgtatgaacacccagctttctccctgcttggctgggaggccatcctctcccctctgtccgaggtgtgttctgccccgtctcccagagttcacagaggcatgaagctccagttgctctgggctgtcctcatcccacaaacacattggctgacttcctcccattccctgtctcacatcttctcctactggtgcttgctgggatcacctcccaaatcaactacttgtaaaataatactgagaatcttgtctcagaggctgcttctggaaaaattcagagacaagcaccaagagttcttcatgccctctcacctgatcctgacactgccccgggagccagcttcatccccatttttctgaggtgtcggctgaggggctcacagaggtaaagcaagcagaaccccagcctgctaggcattagcaagggccagagggctcaagaaaaggtcctgcatcaggcatggtggctcacgtatataatcccagcactttgggaggccaaggcaggcggattacttgagtccaggagttcgagagcagcctgggcaacatggcaaaaccctgtctctacaaaaaaaatcagccaggcacggtggctcatgcctgtaatcccagcaccttgggaggccgaggtgggtggatcatgaggtcaggagatcgagaccatcctggctaacacggtgaaaccccgtctctactaaaaatacaaaaagttagccaggcatggtggcgggcacctgtagtcccagctacttgggaggctgaggcaggagaatggcatgaacccgggaggcgagcttgtagtgagccgagatcgtgccactgcactctagcctgggcaacagagccagactccatctcaaaaaaaaaaaaaaaaatcaaaaacttagccagatgtcgtggctcatgcctatggtcccagctactcgggaggctgaggtgggaggatcgcttgagcccaggagatggaggctgtagtgagccatgatcatgccacttaactccagcctgggcgacagagcaaaaccccatctcaaataactaaataaaataaaaagaaagcgtcctggtcttcatcacagagtgaaactgtcccaaaccgaggctacactccaaccttccagctctttctgctccaggtccagctcccacctcccatgtagccatcctctatccaagaagatggctgtaatgggaccagaatcagcctgtcataaaagatggagaactaagagctctccataaaaatgatctccatggcaaaattaggagggaaaaacagcatggatgaaagttgcatttattaaataataatcgcgaacgctcacttcatgcctactgtatgctagctgctgttccaagtgttttacaatgaaataaatttttaaaatttttgcacaactctttgagataggcactattgctttcttcattttacagtcaaggaactgaggcacgagaaagttatgaagtttgtccagggtcataaagctagcagatgagggaactagactcaggcagtataactccagctacagtcattacaatgagccacacaacgcagtgggtcaaggaggagccactcacacaaagatcgtcccataagattataaccgtattttcaacatacttttctatgtttagatgaggttggaggcaggactggactcgaggtggagcttgcacaccagaccagattgaagactagctgaaacaggaaagaggtaaaaggatgctctgtaagacacacccaccagtgccctgtcagtttactgttgccatggcaacacccggacgttctcaccccttcccatggcaatgacccgtctacgcagaagttactgctatttttctagaaatttcttcataatccaccccttaatttgcatgtaattaaaagtggatcttgaccggctgcagtggctcatgcctgtaatcccagcacttcgaaaggctgaggcaggaggatcacctgagatcaggagtttgagaccagtctggccaatatggtgaaaccccgtctctactaaaaatacaaaaatcagccgggtatggtagcaggcgcctgtaatcccagctactacagaagctgaggtgggagaatcgcttgaaccctggaggcagaagttgcaacgagtcgagatcgcgccaatgcactccagcctgggtgacacagcaagactcgatctcaaaaaaaaaaaaaaaaagtgaatatcaatatgagtgcagaactgcccctggccctgagctgctattctgtcacactgcctgtggcagtacctctgtggctgacgtacgctgcttcaataaaagttgctaacatcaccggctcacccttgaattctttcctggacaaagacaagaactctcccaagctaagccccaattctggggcttgccagtctggcgtcatccatacacagacacttcccactgtgttaccatcgtctatgttatggggtcagttgcatgctgcagtttgtagcctaggggtggcaggctgcaccagccctagtgtgtgggaggctatcccatctagggatgtatagtggactctatgatgttcacacagggttgaaatcacctaatacaacttttctcagaacatatccccgtctttaagggacacacggctgtactcccaaccctcttccccatagggtgcctgtggcacaaagtgggttctctcaatgatccgttgagagacactgtggcactgcgggagacagcgtcccctacaggcctggaggtcccagttttcggttttgttcagatgtgaaggaagttctggcatctgcctagggtggggtgaattttttaggtggggggtggggaatggagtctccctctgttgcccaggctggagtgccgtggtgtgatcttggctcactgcagcctccacctcccgggttcaagcgattctcctgcctcagcctctggagtagttggaattacaggcacgcaccaccatgcccttttgtattcttagcagagacggggttttaccatgtttagccaggctggtctcaaactcctgaccctcaagtgatccgcccacctcagcctcccaaagtgctgggattacaggcatgagccactgcaccgggccttagggtgggatgaaagaggcttaaccaaggctctctgaggacaaaaacatgggatgaccttcttagctttttttttttttttttttgagagggagttttgctcttgtcacccaggctggaatgcagtggcacgatcgtggctggctgcaacctctacctcccgggttcaagcgattctcgtgcctcagtctcccgagtagctgggactacaggtgcctgccaccatgcctggctaatttttgtattttttagtagagacggggtttcactgtgttggccaagctggtctcaaactcctgacctcaggtgatgcacccacctcggcttcccaaagtgctggaattacaggcgtgagccactgcgcctggccagctttgttttttatcatctttattgatacataatttacatatggtaaagtgcacctattttaagtagacagttcaatgagttttgacaaatatatacgtttgtgtagacatcgcaataatcatgatctggaacatttccctcactccttcctgcctctcgacagtcaattccctcctccagtcgccagctggggcagccacttatctgcttgctgtcccttcagttccacctttcctagtgtggtcccctgagcatctgcctctcggctctgcaggaggattttaacacgcagggccccaggccctgcatgcacccagggagcctgatgctgatgatgggacccacatatccgtgtttcagtggtgctcgccaatgcctgagaccactgccttgggactgcgatttttggatggcccacctgggcctgtctcatctggttatgtcccctgagatgagcactgtgcccgggctagttggggtgcctgaaaacaactcatttcccctcactctccaaggaggtacattctgtacctctgccatgtggcagacccgctcagcttttcctgcctgtgacattagagggccaccatgtgaggcagcttttgctaccagaataagggctgcagtgaaaagcacatgcacccccgaggcaatcaggaacatgcttccattatatctgtccagatgacagcatgtggaactaatgatgagtaaaaggtctgcaagccacagcctggccaggccggaaacctgcatgcaccagcttcaggaaagatctgagaggggacctcagtgctgcttcctgcaggattctgacaggcttgaagacaatgctgctaactgaagtatgctgtgggctgtaactgtctctgatcttccccatggcctcatgctcttcacctgacatgtggccaactaggattttcctcatcaacttttttttttttttttgagacagagtttcactcttgtgcccaggctggagtacaatggtgcagtctcagctccctgctacctctatctcttgggttcaagccattctcctgcctcagcctcctaaggagctgggattacaggtgcctgccaccatgcctggctaatttttgtatttttagtagagacggggtttcaccaagttggccaggctggtctcgaactccttacctcaggtgatccgcccacctcagcctcccaaaagtgctgggaatacaggtgtgagccaccacacctggcattctcatcagcatttctatttcaccactgccccggaaacccgggcaatgatcctgagtctacccaccagtacctactggatttccattctgctgactggcctgcttccacatttgccacaatggacaatttcaaaagcttctttttttttttttttttttaagagatggggtcttgtctaggtacaatggctcacacctgtaatcccagcacttttggaggccaaggtgggcacatcacttgaggtcaggagttcaagaccagcctggccaacatggtgaaatccctgtctctactaaaaatacaaaaattagttgggcatgatggcgcatacctgtagtcccagctactcaggaggctgaggcaggagaatcacttgaacccaggagacggaggttgcagtgagccgagatccaaccgctgcactccagcctgggcgacagagtgagactctgtctcaaaaaaacaaaaaacaaaaagagatggggtcttgctatgttgtccagtttggattcaaactcctagactcaagtaagcctcctgctccagcctcccaagcagctgggactatgggcactcatcacccttcccagctttttccaggagcttcttgattccaatctggctccaagcagcaggagaagtaggactgagtgaggaattgggctccagccaccaccaaaggccgcagctcttacctggcgtagagaacaacaaactgtggcaccaacagtcatatccagacaagtccaggaaggccaaggtcagctctgagggccacacatgaaactgagcacgtcagcagtgagcagccagaaggatgaacagacttgaaaccagatcacaggagggatatctggggatgtgttagtccattctcacactgctataaagataatactgagactgagtaattcataaagaaaagagttttaattgactcgtggttctgcatggcaggggaggcctcaggaaacttacaatcatggcagaaggtgaaggggaagcaggcacgtcttacctggcagcaggagagagagagaagagagagagaggggagaaagcagggagagggagagggagagggagagacagggagggagagagagggagagaggaaggaagggagagagggagagagaggaagggagagggagagagggagggagggagagagggagggagggagggagagagggagggagggagagagggagggagggagggagagagggagggagggagagagggagggagggagagagagatcgagagagagagatagatagagatagagagagatagagagagagagagagcacaaaagagaaactgccacttataaaccattagatctcatgagaactccctcactatcacgagaacagcatgggggaaaccacccccgtgacccaattgtctcccaccaggtgcctccctccacggggggattacaatttgagatgagatttgggtggagacacagagcctaaccatatcagggagactatgggcatttagccagaagagaggacatgaatagagcatctgagtgctgaccccaacatctgaaagacccatttgtgggaaacagatgtatttgcacagcctcgggcacagccaggaccagtgggtagacaattcaaggaaggcaattgtttatataaagaattaataacacacagtgaaagatgtccaacaatggacttggacccccagttaaacagtgaactctccaacaggggtgtagccaagtgagggccagaaaacttctaggtgaataagaggcttgacaattagaagacttggattcggggaccttcaagaaccttctatcaatagctgtgagcttctttcaggcaggaatgagccgctgttaatttttctgccaccgtaatcacactgatagccaccaggtggcaacaaagccacaccttcagcaccatggatcatgtcctagccaacagaaaacccattggaaaacaagccccctgccccctcaaccaaaccataaacaactaattgattcagattaattaacatttctggacaaagactgtaaatcaagttctcaaccgagcgtggtgtaatcccagcacttcgggaggccgaggtgggcaaatcacaaggtcagaagtttgagaccagcctggccaacatggtaaaaccccaactctactaaaaatacaaaaattagccaggagtgatggcacacgcctgtaatcctagctactcaggaggctgagacaggagaattgcttgaacccaggaggcagaggttgcagtgagacaggagcatcacttgaacccaggaagtggaggttgcagtgaaacaggagaattgcttgaacccaggaggtggaggttgcagtgagctgagatcgtgtcactgcactccagcctggtggcacagcgagactccatctcagaaaaaacaaataaataaagttatcagtagagctttagttaccagcatgacccagagggctctaggtgaagtgtgtaattgtaattttctttagagatttatcatcttttttgttttaattttccggtgaagtacaacatgcatacagtagcatgcacaaatcatcagcacacagctcagcgcctcttcataaacagagcacccccgtacccagctcaagaaacaaaatgtgatcagaattccagcagcccctcataccccttcctagccctcccctccctaggttacggtgacagccactaccagctttcagctttaatggacaccaccatgcagctttccaaagtgattgtgccaatttacactgccaacaacaatctgagagttccagtggctccagagccacactggaattttctgtttggataagtcttggcggaggaaatgtgggatctggtgaggacatccttgctcccctctgaaggtggtgtgtctgggcagcactaaccagaaggtggaagattccatcccaccagcacatcctggtgaacccatcagcacactaatatctgctgaatggagagtctcgcttcacgtgctctgcacaatgtcccagagtggcgctgctctcaattagcacttactatgtgtgctgcagttttgtttttgttttgttttgtttttagagatagggtctcactctgtcacccaggctggagtgcattagctcactgcagccttgaaaccctggtttcaagcacctttctgcctcagcctcccaggtagctgggactacaggtatgtgctattgtgtctagctgtatgtggacttttcttttttctttttttttcttttttctttttttttttttgagatgaagtcttgctcactctatcgcccaggttggagtgcagtgctgtgatcttggctcattgcactgcaacccgtgcctccccagttcaagtgattctcttccctcagcctcctgagtagctgggattgcaggcatgcaccactacacccagctaatttttgtatttttactagagacgggggtttcaccatgttggccaggctggtctcgaactcctgacctcaggtgatccgcccgcctcagcctcgcaaagagctggaattacaggcttgagccactgtgcccggcccatttttggacttttctaaggactggacatgaaggtgtaaaaagacagacagcatccctgctccactgacactgacattctcgttggggatgggagaggcagaaatacatatctcgggtgatgaaaatttctacgaaaaaaagtggaacaggggaagaagagacacagagtgcaggggaaaaactctatttttaaataggtggttgaggaggcgcttctgataacagtctgtttcctgctgatataccacaaactgggtaatttataatgaaattagaataccacaaactgggtaatttataatgaaaaatttatttctctccctctttaaggctagtcaagtgacgcagtggaagtggagaaggaacaaagaaatctgtaactgattgtgatcaattagttgcaaacatcattgcacttggaccagccagaaaagaaatttatttcttacacaagacagagaggcaccggggccagactcgctttataacaatccaccctctcaataaccaacccactccttccgtaataacgacattaattcatgaaggctccacccccattcatgattcaatcgcctcttattaggccccacctcccaatatcatgcactggggataaagtctccaacacagaaattgttgagggacatgttcaagccacagcaataacgttgagcagaaaccaaaagaaaatgaggggagcaaatcacagaaaaatagttccagatgcagggagctgtcccgtgacaaggccctgaggtcagtgtatgtttggcacattcaagagctggtgggagaaggaagggtaagaaatgcagggagagttggagggatgtgactgtataggacctacccccattgatgttcaaaagcaaccgcaaacccatccaatacacacatgtgtagtcgtatcaagagctgggggttttaggccaggcaaggtggctcatgcctgtaatcccagcactttgaaaggccgaggtgggcagatcagttgagtctaggagttcgagactagcctgggcaacatggcaaaaccccatctctaaaaaaaattagctggacgtggtggcgcatgccagtagtcccagctactcaggaggctgaggtgggaaaatttcctgagcccgggaggtggagattgcagtaagccaagatggcaccactgcactgcagcctggatgaccaagtgagactctgactcaaaaaaaaaaaaaaagcggggtggggcggggcttgaggtggtgttatttacaaaaacaatgggatcatgcatatattaaaacttgccttcttaacaacactcagaagcatcattagtggtcagtcacacagattgaggtaagcaaacctcttctgtgaagagccagcgaggaaatagttcaggctttgcaggctggatagtctctgttgcaaccactcaatataataacaaatcaagactgctgttgtagcttgagaggagccatagacaatgtgtaaatgaatgggtgatactgtgttcccacagaaccttatttacaaaacaagtggcaggccaagatttgactggggccctagtttgcaaagctgacacatgacgttactatggttttcccaatgctgagaacagtaggcattcgataaatatttatttgaaatgagaataatcttacttattttcattgtggaagagtattccatggcttgaataagcatccctggacctatgattttacaaactggccccttgtcaaatagatttctaggattaaggttactgggtcaaaggtttatgaacttgctgtttgtcaattaaccactacctccctgaaaccctttccactcctagcttctgtgacaccacactcttttcgggttttttccttacctttttagacacttcccagttgccattcctaaatttttggaagggagggggacaggtcttcactctgtggcccaggctggagagaagtcacacaatcacgactcactgcagcctgaaacacctgggctcaagtgatcctcctgcctttgcctcccaagtagctaggactacaggtgcgtgccgccatgcctactaacatttttctttctttttttgacacgtagtctcgttctgtcgcccaggctggagtgcagtagtgcaatctctgctcactgcgacctccacctcccgggtttaagcgattctcagtctcccgagcagctgggattacaggcctgcaccaccacacacggctaatttttgtgtttttagtggagacagggtttcaccattttggccaggctggtctcgaactcctgacctcaagtgatctgcccacctcgtcctcccaaagtgttgggattacaggcgttagccactgtgcctggccttttttcattttttgtagacttgctatattgcccaggctggtcttgaactcctggcctccagagatcctcccacctcatcctcccaaagcgctaggattacaagcacaagtccctgcacccagcttccattcctaaatttaacaaaatttcagagtccctgtggtagtgtgtgtggaattggttccttccggtgggttcttggtcttgctgacttcaagaatgaagccgcggaccctcgcagtgagtgttacagttcttaaagatggtgtgtccggagtttctccttcagatgttcagatgtgtcccgagttccttccttccagtgggttcgtggtcttaagctgcagaccttctgcagtgagtgttacagctcttaaaggtagtgcggacccaaagagtgggcagcagcaagatttatatgtgcatgtatacataaatatgtatagagagaggcttaagtccatggaatgtagttagggaaaggagaatttgacaatgataacatttgttactcatcaaactctcatttttaaaaaatttattaaaattatttgcaagagttgaagcaggaaatgacactcttacggtattggtgggactggacattgctttggggagttagtgggatagtatttattgaaggatagggaattcgtttgtcaaagagaaagatgcagctgatatcatccactcttcctctcacttctctttcccaaagcccagtggctacccctaacaaaaaacccaagagcactgctgcggaagagaaaacagtttcaaatatcataattgagagaggtgctggattgtcaccattctgtggagtcttcctgaggacccaactctgctgatgtgttgggagaacaactcaaaggagaaatggtagatgtgcagcatgggagctcatatcttttcttatttctttctttcctttctctcctttcttttttagacaagagtcttgctctgtcacccaggctggagtgaagtggagccatcatacctcactgcagccttgacctccagggctcaagtgatcctcccacctcagtccctggagtagctgggactacaagtatacgccgccagtactggccttttttttttttaagagatggagtcttgctatgttgttcaggctggtcttgtgctcctgggatcaagtgatcccatctctgcctctcaaggtgatgggattacaggtgtgagccacggtgcccggcaaatcccctctcgtagcaactcaggtgtatttgtatggagtggagtgaatatagcagtagttgctccaggaacagaatccagaattggaaactgtcagtgacagagttagaaagaatcatgaatcagatgactgaaagatcctctgaggctcttccaactgggagattggattgcatgttgccaagctagtccaaacttcgttttaaaaacttccataggctgggcatggtggctcatgcctgtaatcccagcactttgggaggatgaggcttgaactccttgagcccaggagatcaagatcagcctgggtaacatagggagaccctgcctctatttaaaaaagaaaagaaaaaaacttctgtacaggattcatttggaatagcacttctcaacctcagctattgacattggggaccagataatccttcgtggtggggctgtcctgtgccttgcaggatgtttcgtggcatccctggcctctacccatgagatacgagcagctccttccctcctccagctgtgacaaccagaaagtcttcagatattgacagatgtccgcaggggggacagaactaccccctgttgagaaccactgccccctgttgagagccttcccaatagctgtgactataggcatgtgccaccatgcccagctaattttttaaaaaaaaagttttttgtagagatgggatcttgccatgttgcccaggttgatatcgaactcctgggctcaagcaatcctctcacctgggcctcccaaagtgctgggattacaggcgtgagctactacgccttgctccttgcttttctttatttcattgagtcagtgtcttgctttgtcatccaggctgcagtgcagtggcatgatcatagcttactgcagcctcgaactcctgggctcaagagatcttcctgcctcagcttcccaaggtgcagggattacagaatcatattttttatctgactttaagcacggtctctatctcccccagtcgtgacaaacaacgtttccctccagactgccaaatagctccaggagggcaaaccccgcccccccttttcaacccgaagcggaaggatattgaggttgcaccactcaaaacagagcaggaatacaaaaatatccaaagagctggtgttgggcttggcacaatggctcacgcctataatcccagcactttgggaggcagagacgggtggatcacctcaggttgggagttcgaaacgagaccagcctaacatggtgaaaccccgtctctactaaaaatacaaaattagctgggcgtggtggtgcatgcctgtaatcccagctactcgggaggctgaggcaggagaatcacttgaacccaggaggcggaggttgcagtgagccgagatggcacaggtgtgagccacagagcctggcctgggctgcgttctttcaggaggctctggggcgaatctgttccctcgtgtcttccagcttccagaggctactggcaccctttggcttatggttccttcctccatcttcaaagccattaacttcggttgtgactttcttacagccaatcactctgaccccaatcccagcctcctttgtcacatctgcttctctgactgtggctctcctgtccccctcttgtaatcacccttatgatcacatggggcccacctggacaatcccggggcatctctgcatctcaagatgctcaacttaatcagatctgcaaagtcccttttgacatacaaggtaacatcttcacaggtttcagggattaggattaggattaggacatagacatctttagggggaacccttattctgcctaccgaggtgaagaggtgaagccggctgggcttctgggttgggtggggacttggagaactttcccgtctagctaaaggattgaaaacacaccaatcagtgctctctgtctagctaaaggtttgtaaacacaccaatcagcactctgtaaaaacggaccaatcaacattctgtaaaatggaccaatcagcaggatgtaggcagggccaaataagggactaaaaactggcggtccagccagcagtggcaacccgctcgggtccccttccacgctgcggaagctttgttctttccttcaggcaggttggagtcttgctttgtcacccaggctggagtgcagtggcatgatcatagctcactgcagcctcgaacacctgggctcaagagatcctcttgcctcagcttcccaaggtgtggggattacagactcgtattttttatttatctaactttaagcacggcctctacctcccccagtcgtgacaaacaacgtttccctctagacttccaaatagctccaggaggacaaaacccccctttttcaacccgaagcttaaggatattgaggttgcaccactcaaaacagagcaggaatacataaatatctaaagagctggtgttatctcagtgatatccctttttttttttttttttttttttagcttcggcggtgacacctactctcctggtcttctccctacctcgctagtcactcctcccagtctcctttcctgcgcttaaatttcagagtaccccaggcgttggcctgggtcttccgctctccacttaaacttactcctttgaggttttcaatctggttctacagctttaaatagcatctccattgataaactcacaaaataaggcactttcaagtcagtggaggaaatgatagtattgggacaaaggactttccatacacgggagaaaaaaaatcgttcgtcgctgtgggagggctgccgggtctcgtccacgctcccttttgagcacctacagtgagcgtaggattgccacggatagcccaatccacaagtgagtcaagctgccagggctccaagaaagacccatggagggagaggggaacgtccggggaggcgaaggctgcgagtgagacccggagaggctgatgtcggcgggtctgcgcgctcgcaacgcgacctccgcccggtcagcaagacctcggcgcgcgatcctcagattctgcgaaacaagacaagcgactgggtccgagaccgcggtccccatcaaaacgagcatcaaccaatcgctgggagaaatccgcagcctcgttttaagccaccaagcagagaccgcggcgacctattatgataacctcgagaaccaatgaaaaacggggattcgctcagcccgcctcccgagcttcaaccccgaagagatcgcgcacagttttataaaaggtacaaattagaaagcagttctgcggctggattagagacattgtgttttcaaagacggtggggagggctagagaaaaatcctagaagctagcaagaccgcactacaccgaaacgtcgcgggcaacggactcgccagtcaccatctagcccagggacgacgcgggacggacgtgccgctgcgcgctgacatcacgctccaggccccgccccaccggccgcccatatagcgaaagcctggcgcgcgcgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtgagtcgggcctgggcgcccgcgcccagcgtcccaggcctggtggcggcgggaactctccaaggaaagaagcggccaaggccgcggcgccgcgtggcagggcctcaaagatggcgacggcgcggcgtcgcgggggcgcgcggtggggtacgggcgcgcgcacgtgcgcgtcctggctaacgactcccccgcggttgtccggccctcgcaccgcccctaggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtgagtcccacccccgcgcgctccgcgcccttggggaccctgggggcgggggtgggtggggtggggcctcccagcccgggcaggcgcgagggccgggggtcgtttgacttgggtgtccccgagccccgctgccttcacgtctgcccggggcagccatgggacgccggagcgcggggattgggtttgggtgtttggttttgtttatttgccaagttgggaggtgggtggcttcttctggccccttgtcagcactgtcacgggttcttcccacagaggaagtaaggggtggctgtatttgttgtattctccttacttacctatcagtgcattagttagaggttcgggggcaggctcgggtggaggtggggtagggggcgcgggggacggggaaggggaggagcataaagtataggtcttaaagctatggaacttgatgggggccaaagaatgtactatttttaagtaatgtggtattgtaccacaaagtagatctaaataagctttatgctgtatttgaactaattggggcatgttattgggaggaggttggggggatttttggttatgttaaatgtttgatgtttaaattgttgcatgttgaattcaaactttttaacaagtccttgatgtttcaatttgaaagtgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtaagtacttagtgtaaaactagtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggtatgttttgtaattcaagatagaaatgatatgactaatgctttaaagtaaactccttttatattcttatttctgggaatttattatggtatatagatgttttaagatttccgagtctgaccaatcttgtctttcaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtaacttgttgaaggacactgtgggaaggaaacaatatttgccaataaaaagggagtaattgagtgatgtcaattgttgcctacttgaattaaagccagcttttagtttgttttggctgtgcatcattgcgttcttttctggatgttttgaacagtgtatttaatttcgtagtaaagaaaaacattattctttggcttatctatttttgccagatggcacggatgtatttaagttggattgggattaagacttcattgtttttctcctaataggtctcgatctagaagacggtcacgaagtaggagtcgcaggagcagccgcagtagatctcgaagtatctcaaaaagtcgctcccggtaaataacgttgtgttgagtcactgtgaatattaccgtacttgtttatggagtatgtgtacattctcactaagtattgagaaaatcggtctttccttgtccagttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaggcttgttttgagtttattgcatatgcccacttaggaccagattcttaacaaatgtttttttgaattggagtttgcattggcaagccattcctgtcttgagtatgagaacaggatcttgtgttcacttacccagaaacgtgagtttgggatttagtatatggtttatgttgggcaactcattaatcactgtgcttcagtgtcatccatgaaactagggataaaacatgcatgggatgtgaagattaaaagtcaagaatatgaacagtacaagagagtaccataacaaatacaattttatttacaaatatacatggttggaccataccttggaatctacttgctaatgcagctgctgttaacagttcttgtatctgctcaagagatttctatgatcatataaaaatgcctttttaggttttcagtgttcatgccctgagtagtagtctgcagtttgctttaatacatggtaatacagagatcggctttaaatggctggctggttactgttgaatgaatgtatgataaattttttttcagaaccaacagtgtgaataatcctttcagttgtctatcagcatgaatttaaaaattactttcaagattcaacattacacaataaaacttagagttcttgcaatagagcacctagtgtagtaattaccgatttatatgctaatctttgagtttcctcagtgaccatattttgaataacagattagtatcccgaacatgtatgcatccatttactgaaacgacaagtcagtacaattgtgcagttggtcttcgtacatcctatatagcttgtttacatatgcctgtttatctttgagcaatcctgcagatggcccccagtatagcacttaacacagtcgttaactttttattccttttgaatagaaaggaatcatggttcaaaaattagaagagtgggtgcggtggctcatgcctgtaatcccggcactttgggaggccaagacaggaggatcacctgagctcaggaattcaagaccagcctggccaacatggtgaaaccctgtctccaccaaaaatataaaaattagccaggcatggtgttgcgtgcttgtagtcctactacttgggagactgagacagacagaagaattgcttgaacccaggaggcggaggttgcagttagccaagataacaccatggcactccagcctgggcgacagagtgaaaccctgtctcaaaaaaaattttttttcaatgtgttttctgggaacagggccattatcttctgtaactacagaattatcaaaatcaggaaattaactgataaaatactgttgtctgatacacagttcataccgaagtttcatcagttgtcccttaatgtcccttacattttttctcttggtccaagattcattggttgcattttgttgtcatggttcttgagtctctaaatctctaatgcatcctcaggctttttcttcatgttactttttgaagaggagttaatatacctagcctccagttagcctcctctccctcaaaattattttaaaaaatgacttaatagtgatccaggttattaacatgggtcactggacataatacatcgaggacagagtctcattcttgtgatattcctgcccaaaatgctgtcatgtagaaacgagacaaatccaagatgagggcaaaacctacaaaataaacttttcttccccccacgagacagagtttaactattgttacccaggctggagtgcgatggtgcaatctcagctcaccacaacctccacctcctgggctgaagctattcacctccctcaacctcccgagtagctgggattacaggcatgtgccaccacgcccagctaagattgtatttttttaatagaggcagggtttctccatgttggtcaggctgatctcgaactcctgacctcaggtgatcccccgcctcggcctcccaaagtgctgggactacaggtgtgagctaccttgcctggccttctaccataaaggaattgctttggaggggtggcggggaggagggggcaggtacactatatgggttttctttaggttttctgttttttaagagatggagtctcactctgttacccaggctggagtgcagtggtgcaatcatgggcccaagcgatgctcccacctcagtctcccaaattgccgagacaagtgtgcaccaccacacccagctaagggagtagacttttaaaggtaaggtttaaagaaggtggttttttatttttgtctttaggagggaaccaatttggagattaagagctgctgaaggcaaagctttgatggcatcagatagaacccccattactgctgaaagcagagcaagtcccctagcccaaggccaaaaggattgggaggcaaataagttgcaccctcatctataaaacaagacctgctaatattgtgaaaagtaaatactattatcaaagcatttggcatagtcactcattaaatagtaactgcatttaggaaaacattctgaaatagaagagctaaactctccgggtgtgatggctcattcctgtaaaggaggccaaggcaggcagatcacttgagatcagcagttggagaccagcctggctaacatggtgaaaccccatctctactaataatacaaaaagctgggcgtggtggcgcaggcctgtaatccccgctaccctggagaccaaggcaaaagaaacgcctgaacctaggaggggggtttacagtgagcagagactgcaccactgtactccagcctgagcaacagagcaagactctgtctcaaaaaaagaaaaaaaaatagctaaactctaataatactgttctaaccaacttgagaaaaaggcaaaacaaagatgccaaacgtggaatgtggtgcccaagtattaaagtatctactatccctactttttcgtccttcatgagcagcccgagtgtactaaacacattactgttacttttgtcatacaaagtttcaaacaccagtgagaatagtggaatgaaccacccttgtgctcctctagctttaacaatgtatacctgtctacttcctctcccaaataattttgaaggaaatcctagacattttatctgtagatgcactatatagctctttaaagacatctaaactctctttaaatctagagtctctttgtccccttgcagtgtgtttattggagaagctaagtcattgtcctggagagtttcccagtcttgattttgctgattgcaatctcatggcgtcattaagtgtattctcctgtatgctgcatttcctgtaaattaatagacctagagaaagcgggtgtgtgtgtgtgtgtgtgtgtgtgtgtgtgtgtgtgtgaagggtctcactgtatcacccaggttagagttgcagtgttacaatcagctcacgcaacttctgcctcctgggctccagcgatcgtcccacctcagcctcctgagtagctgccaccatgcccagctaattttttctctttttggtagagacggggtttcaccatgttgcccaggcttgtctcaaactcctgacctcaagcgatcctcccaccttggcctcccaaagtgctgggattacaggcatgagccactgcacccagcaagaagtgtggttctgccaaggcacagtggctcacgcctgtaattccaacactctgggaggatcctttgagcccaggagtttgagaccagcctgggcaacatagtgagaccccatctctacaaaaaaattaaaaatcagactgatgctgcccacctgtcccatctgctcaggaggctgaggtgggaggatcacttgagcccaggaggttaaggctgcattgagccaatcatgcctctgcactctaacctgggtgacagagcaagaccctgtcttaaaaaaaaaaaaaaaaaaaaaaacatggttcccaaccagcagcatcaaaatcatctccgatgttagatgttacaaatacagtcttcaccccagactctgaatcaaaaactgtggatagagtcaggcacagaaagacaaacttcacatgttctcacatatttgtgggagctaaaaatcaaaacagttgaattcctggaaatagtaaaaggatggttatgagaggctgggaaggggtagtaagggggtgaggggtaggtagggatggttaatgggtccaaaaaagaataaaatatagtatgtgatagcacacagggtgactatagtctgtaatttaattgtacattttaaaataaagactatataactggattgtttgtaacattaaggataaatgcttgagggtatgtctgtgtagtgtgggtaattaaaaagaaaaaataaaaatacaaaaaaatgcttgagaggatgaataccccattttccatgttgcgattgttacacattgcatgtctgtatcaaagtatctcatttactttatgaatatatacacctactatgtacccacaacaattttttttttttttttgagatagagtatcgctctgttggcccagccaactttttttttaaacaaataaattaaaactctgggccgggcacagtggctcactcctataatcccagcactttggtaggccgaggcaggtggatcacctgaggtcaggagttcgagaccagcctgagcaaggtcgtgaaaccccacctctactaaaaatacaaaaattagccgggcatggtgtcgcatgcctgcaatcccaactacttgggaggctgaggcaggagaattccttgaacccaggaggtagaggttgcagtgagccaagatcgtgctccagtatggggaccgagtgatactctgtctcaaataaatatttaaaaaataaaactgggtagagcgcagccataggtgttttttaaagccccttaggtggttctggcacatactaaaacttaagacccactattctagtggttttgtcaaattccaattttaaaaaaaaatttgaataggatgtgcaagtgcaggtttgttacatgcatatattctgtcggtgagtctgggctttcagtgtgcccatcaccacctttatttttgtttcaaaacttcttgggggctgggcatcgtggctcatgcctgtaatcccagcacttttgggaggctgaggtaggcagatgacttgagcccaggaattcaagaccagcctgggcaacatagggagaccctgcttctacaaaaaaatagaaaaattggccaggcatggtggcaggtgcctgtagtcccagctacttgggaggctgaagtggaggatcacctgggccctggaggtggaggctgcagtgagccgagatcacgcctctgcactccagcctgggtgacagagcaagactgtctcaaaaaaaagaaaaaacagaaaactacgtgggggcgagtgcggtgtcccacacctataggaagccaaggtgggaggagttcaaggagttgaaggccaggagttcaagaccagcctgggtaacttagcaagaccccatttgaacgtcttttttgtcataatggcaaccattgattatttttgcctagatacattaaaccatggacttgtggctttaaacatttatttcaatccattgcagctcgtcttatcaatgctacctttttatttttttcttttttgagttagggtctcactctgttacttaggctggaatacagtggcatgatcacggctcactgcagccttaacctcctggggtcaagccatcctcccacctcagcctcccaagtagctgggactacaggcacatgccaccacgcctggctaatttttgtattttttgtagggacggagtttcgccatgttagccaggctgcttttgaactcctgagctcaagcaatctgcctgcctctgcctcccaaagtgttgggattacagaggtgggccactgtgcctggccttctaatcaatgatacctaattctgtcttcggtcagtggaactcaactcaatttgtctcctgagtccttttgaaactattctaatcttgtcagtttcctcgctttctggtatggtaagatttccagcatcatgttgtacattttcagtccagatctgaaatcagtcatttctccaaggagccctggttttgttggaaatggtatttagcaaccagtctgggcaataagcaaattcattgccacttgtttggtcataggccttttcggtggacagagctaggaaaatattacctgattctccctctagccacacaaatcatgttaccttctggtcatctgaaggtcctctcttctccaagcggaaaccctctcaaccctgcctcagtcagtgccacagttttgaatctcctaactatatgttgtctttctgcactcttaatttgtgagtgccactctttttttttttttttttttctgaggcggagtcttgctctgttgcccaggctggagtgcaatggcgcgatctcagctcactgcaagctccgcctcgcgggttcacgccattctcctgcctcagcctcccaagtagctgggactacaggcacccgccaccacgcctggctaattttttttgtatttttggtagagacggggtttcaccatgttagccaggatggtctcgatctcctgacttcatgatccgcccgcctcggcctcccaaagtgctgggattacaggcatgagccaccgtacccggcgttgtgtgtgccactcttacagagtggtgtccactggtagacaaagcactccaggtttgctctaacctgctcaaagcagagcagtacatggcttccctgcctggatatatggttcctcagctgacttctgggccgtttctggcaaagggataagaggattaaaaggaaactgtttctctaagatcctgcagcctcttttccgcgccgtcagagggtttaaagcagataatgtgtcatcttgctctgaataatgagtagaggaagaaggaaaattcagagcctaactttcaatgtgattctagagtacacaacagcactataaatggaatgagtaaataaatacctcaaattatagttttcatccaccttgaccattgcctgcagacctagcagtaactcaagtccagacaacagtgtggctgtgatcataataagatgatcagtgctcactagtgttttcaggaagtttttcaggaagccctcgaaaagtatagcaccatgagtcatcatagtccaactcatattcagtaagcgtttattaaaaactttggccgggcgcagtggctcacacctgtaatccctgcactttgggaggccgaggcgggtagatcgcttgaggtcaggaggtcaagaccggcctggccaacagggcgaaaccccatcactactaaaaatacaaaaattagctgggcatggtggtgggcgcctgtaatcccagctagtccagaggctgaagcaggaggatcacttgaacccaggaggcagaggttgcagtaagccaagatcaccccactgcactccatcctgggcgacagagcaagactctgtctccaaaaaaaaaaaaaaaaatgccttaccagatgtgtggtagattacattactataagaaatatttattgtctcccttttctgcatttatgagtacttccctcacttgatgttggccaatggaatttagcaggcatgatctatttggtaggctgaatgatgccctcccccaccccccaaaaggtccacgagctaatctccagaacctgtgaatatgtaacttaacattgtaaaagacactttgcagatgtaattaaataacgttctggagatgtaattatctggctaggcccagtgtaatcacaaagggaggctttttttttgactctccagcctcccttataatctagagaggctggagagtcaaaaatcagaaaaagttggtgtaaaaatggaagcaacagtagattggagatgctctactgtcagctctgaagatggacggagccacggaacaaggaaacggattctccctaagggagcacagccctgccgactccctgactgggcccatgcctccctccctcccttgattggcccagtgaaacccatttctgacttttgacctccagaaccataagacaataaatttgtgttattaggttggtgtaaatgtaattgcagtttttgccattactttgaaaatattttaggccgggcgctgtggctcacgcctgtaatcccagcactttgggaggccgaggagggcggatcacgaggtcaggagatcgagaccatcctcactaacatggtgaaaccccgtctctactaaaaatacaaaaaattagccaggagtggtggcgggcacctgtagctccagctactcgggaggatgaggcaggagaatggcgtgaacctgggactcggaggttgcagtgagccgacatgtgccactgcactccagcctgggtgacagagcaagactccatctcaaaaaaaaaaaaaaaaaaaattttagaccaccaagtttgtggtaatttgttaccaaagctccagaaaaattattacaacacagctaaagccttaagacacacttgcacacctgggcttgctctcctgcatcccagctgtctccatgagaataatacacctcagccagcctgctggtccaagaggacaagagacaggctggccagagctgcctgtgagccttggccaccagctcgaagcagaacccagccagatcagccaacctgcagaaatgtgaaaagtaaaaatgtagtggtgtgtgctactcagttttgggggttagggacaatgatagctaactgatacggggtgctaggcaactccacatatgtccctgcaataactatacgtggtagaaactgttacccagcattttacagatgatgaaacaggtcaggtaaacccacatgcccaaagtcacacacaaggcagcattctgaagttcagtcgtttcattttgcctaaatgaatatgagagatatcttccatttttccatcccaattccctatccgcctgtctgagcctcaggaaactagcctcatgacttcctccacacacttccctgccctctggtttctgagtgggacgtggagagagggaggagatggaagttggggtctttattcccacagcaccccacccctacccccgcagacttaactaaggctggcagtggccttcaaccaaaggccatagtgtctggtgtacacagccctcttgttccaagtcccggtaaccactgcctccccttgtcctagcccctccgtcttacgctaaccattgtaatttttctacatcctgcccacaccattataaataagttaatgatttattgtgtcgtcttcaaattactgaagtggggagtgtgccttctgtttcctgttgtgacgctgcagataatagcaagtaagttaaacagtaagtaaatatttcctatttcagaggaatataaaacatcacacttagtgcttgcttcagcagcatatatactaaaattggaacgatacagagaagattagcatgacccctgcgcaaggatggcacgcaaatttgtgaagcattccatattttaattaaaaattatttaaaaaataaagaataaatatcgggggtagatatgcaggcaggacggggcaaagctctgaggggtagggtatgcaggtcagcattatctagttgcaatggttatgttgggtaatgggccacctggtggtctagctggaggcaacaaggctgtaaatcaattgttcattctttcctgagatgggacactctcaaccttggtttgatattctggatctcctaaggccagttcctggaattatttaaataaaaggcatggttaaacattaagagagcacagaagaacaatatagaatggctggactaggtgtggtggctcacacctgtaatcactttgggaggctaaggcaagaggatcacttgagcctaggagttcgagaccagccggggcaacgtagtgagaccctgtctctacaaaagaattaaaaattaggcaggtgtggtggcgtgcacctgtagtcctgtaggtctaaaactggcctgtttggagatttggttattatttcactctctcctgatttccttgaaggtttgataacaatcctggtttcaggctgggtgcagtggctcacacctgtaaatcccagcactttgggaggccaaggcaggtgtgtcacctgaggtcgggagttcgagaccagcctggccaacatggtgaaaccctgtctctactaaaaataacaaaaattagctgggcgtggtggtgggcgcctataatccccagctactcaggaggttgaggcaggagaattgcttgaacctgggagatagaggttgaagtgagccgagatcatgccattgcactccagcctgggtgacgagagcaaaattccatctcaaaaaaaaaaaaaaaaaaaaaaaatattggttttggcttggtggtgtagaacttcagcatttgtactccattttggtttggtccattgggtctaatgccagagcccagtccaaataatgaactcctaaaaattgtatttaacataaggaagggaaggaaggagatagagggaaagggggcatgagaaagaagggaatgaggccaggtgtgtggctcacacctgtaatcccagcactttagggggcagaggcaggaggattgcttgaactcgagttcgagaccagcctgggcaacatagtgagacctcgtctctttaaaaaaaaaaaaaaagagactgaagaagaaaggaagtagagagaaaggaaggaaagaactcactcttcatttgtatttcctggctctaggtttgctaaatatatgtgtatattctgacactttttaaaacagtaaagaggattttattcaggactattggaagaggggagagaggtctgcctcaaccaaacagcaagggcaagaagtggggatttatagccaacaagaagagtgaggggtcatggctgaaaaaataattagagcagacatcatgggtagggggattctagctaaactgaactcacaggattcttgctagaggcagaccaaggacttacatatcagaggtgaaggatcagaaacttgatcagatatgaaggatgggggataacttaacaggattcttattaaaactgggccaggcaggccaaggacaggagggagtggaggccaagtttggacaaggagagagccttttgtcagttttttaaatcactctttgagtatgagcctggggaactggagaattcatttttttctttttaaaatgtagatatgaggttttgcgacattacccaggctggtcttgagcttctaagctcaagcaattcgcccacctcagcctcccaaagtgctgggattgtaggcatgagctgctgcacctggctgagaattcaaaaacagtaaaaattagtaagattagagtactttaatgtggtgcttcacagtatacaacgttcttaaaatcagggccgggcacggtagctcatgtctgtaatcccagcactttgggaggccaaggctggtggaagtcaggagttcaagaccagcctggccaacatggcgaaaccccgtctctactaaaaatacaaaaattacccgggcgtggtggcgcatgtctgtaatcccaggtactcgggaggctgaggcacgagaatcacttgatcctgggaagtggaagctgcaatgagccgagatcacacaactccactccagcctgggagacagactgagactctgtctcaaaaaataatattaaaaaaaataaaatcagtaacctgaggatactggatatcaactcctgtgtccaatttatttcattaaccactttagtaaatattagaacactacacagagctgtatcatcaagttgaaccacactccaattttcagggcaactgctgtgaagtcaatagtagcagcatccccacaagcagtctgcaccattttcttgggccttgtttgaagccacattgcatacatcccacaagtctctactaaaaatacaaaacttaggcgtggtggcacaagcctgtgattccagctactcaggaggctgagctgggaggatggcttgaacccagaaggcggaggctgcagtgagctgagatcgggccactggactccagcctgggcaacagagtgagacgctatctcaaaaaaagaaaaaagaaatgccgtttagctcttccctgtttttgcacataccagcagtagaacgaaagtctcacatagttagcttaaaaattaataataataaaatcagtgggcactgtagcatgcacttgtagtcccagctactcagcagactgaggtgggaaaattgcttgaacccagaagtttgaggctgcagtgagctgtgattgcaccactggggacgccagcctgggtaacagagtaagactttgtttctttacaaaaaaaaaaaaaaaaaaaaaaagtctgcagctccatagtctaattgatagaaacaagaattaagttcctacggcatatttggcatattcctggtaacaaaaacatcaccaaacttctaaacaagatcaaaacacttctaatattaaacactgaaataaatgtgagctacacttaccttttacaaagattaatagaaacgagaataattgacccaatttttggttaatcagtgagtgagggcggtcgtcgtggtgatgggttaaatcacggaataaatgttcgtaaagcaaaaattttcaggagcacgtcctcctgctctacagttcaaaaataagaaccaatctggcaggctcgctgagcgtttttggatcacgtcatttattgtcctgcatttgtatgattatcatatactgtatggattttttattttacagtaatttgtattcactaattttcattcattccgtttccaagctgcttattccaattcagggtctcaggtggcagcctgtcctagcaactcaggacgccaggtgggcgtccccccagacagtatgctgtcccatcacagagcgcgcgtgcacacacacacacatacacacacactcaggaaccatttagacacgccagtccacctaaagtgcacatccatgggatgtgggaggaaaccaggatacctggagaaaacccacgcaggcatgaggagaacatgcaaactccacacagacagtggccctggctgggaatcgatttgttttctcaacaacgttataacaaaaggatgttgagtgtaatgatgttatttgaggacttgctgtaattaaccaactggccagtcgactgcatctttatagttactattattccatgtgcaaacaggagatccaaagaaggagagaagggttagaaatccatttttttcttatcaaaatatattattttatccatttcattacagtcttttatccatttcattacagtctttcctgagcaaagtggaagttcaagtcaaaagtcagatgaaagtcgctttaaagttcaaagaggagaagaaatgaacttttcttttgagagcctcttttgtgccaggtgcttgccccttgctatgagaaatgtcaagatctttgcatctattgaagtacagagtaaaaatttttttaaaaacgcaaagatgaatacgatgagagtttgtgacctcatgccacataccaaatcaggacaaggctatcagtaatagcacctgagattctccgggctagaataaacctccatcatcatcttgttctatcccttatctgatactcgagtcagctcttgcttcttcatacccagtctgcctagcttttttttttttttttttgacaggttctcactctgctgcccaagctggagttcagctgtgcaatcttggctcactgcaacctcagcctcctgggcttaagcaatcctcaggcacacagcactacgcccagctaattatcttctgtatttttttgtagagacagggttttgtcttgttgcccaggatggtctcaaactcctaggctcaaatgatctactcaccttggcttcctaaagtgctgggattacaggcatgagccaccacacccagcctgcttagctgttttaaaataaaaactttagacaaattaaatgtaacagagtttaattgagcaaagaacgatcggtcaatcagccccctaaaccagaataggttcagaaaaactccagggttgctgcatggtcagagaagacctatggacagaaataggaaagtgacatacaaaaaacagaaatgagatacagaaacagctggatgtgttacaacttggcatttgccttatttgaacacagtttgaacagttggccgtctttgattgaccaaaactcagtgattggtatgagagtgggttacagtctgtttacacattcagctagaatatacttcactatgtacagagaaatccttaggctgaatataaggaggcagatttaggctaaacttaatttaacagttccccgcttttggtcaacctctcaaaactttaggcattgatatcattctgtcatcattgtaaatgtacttatttggtctcaaatcccacttggaaacagcagaacagtgagttttgtgagggctttagattaccttttggtaagggttagagtagaggggatctccttgtgctaaaatctcctattttctattctacaatctcttggtctgttttaggatctatctgcttctttaaagttttagtttgattattttgcatttagcatgaatgactccattttggtgtaatctgttctggtctgttggggtctagtacatgagctcactccaaacttatgacttgctgccatcattttgtttaaaaaccctccccttttagttaagctctcacttaggaatgtgaccaaaactcagggctttagcagcaatctcagttaccatcatctgggtttctagtttcaacacaaaacttacaggttacagtgtcctcatggttatgttgtttaaaattttgttgttccagttgaagagagaccatatgacattctatgatggctgtgtgcaaacacttaaaatttttgagagaatacagtgtaccagggagaatactattattaaaatgactatcaggaagataatatcaagagtttggagtatgtgccatagagtccccatgaaccaaaccaacaaaaatcaaatagatcaaagaatgaactagatagagtcgattcctttcaaccaagcgtgaaattaattataggggatttgttaattttctataactgaacctctgtaatacccaatgtattcttctatgtacaagaagtgtcagcattgtgcacatgtaccctaaaacttaaagtataataataataaaataaaataagaaaattattaaatgcttaacaagtaataaaagaatttaaaaatgaaaaaaaaagaagtgtcagcaactgcacagatatttctctattcagccattaagtaatctaaagcaattctattatctagcacaaccttatttattcaatttttttgaaacaggatctcattctgtcactcaagctggagatcataactcactgcagcctcaatctcccaggctcaagtgattctcctgcctcagcctctcaagtagctgggactacaggcacgtgacaccatatttggctaatttttgtgtttattttttgtagagatggtatcttgctatgttgcccaggctagtcacaaactcctgtgctcaagcaatccgctggcctctgcctcacaaagtgctgggattacagacatgagcccagcctactacaacttagcaaaataaattaaagtctgttgtctaacgaaaacctttgtagtagaatctgttatagagactattataagggatacatttctaattattgcctcatttactccaaaccatagaaaaagagatctaacaagtgatgcccatctagaagactgaagcccccctggcgatgttttctttttcttttttcttttttttttaagaagcagtgaaagtttttcaaaaagttttagagcaggaacgaaaggaagtaaaatacacttggaacagggccaagcaggcaacttgagcaatccaagtgccctgtttgaccttagacttggggttttatacactagcatgcttctggagttttgcatctctcctcccttgatttttccttggggcaggctgtccgcatgtgcagtagcctgccaacacttgggagggggtgcatgcatggtgtgtttactgaagcagtgtgcatgctcacttgagacattttccccttaccagccgagtgttcctagcgaaaggtcgtgtaccagttaaactccaccattttgcctcttaatgcacatgcttagacccactcgcccaaattctgagatcttagtgggaagctgcggatcaccagcttcaggtgttttctatctattgggagattgatttttccttgatgccagatgtgaccaattattattttagagagacagcttaacaactgcctgaccattacctgatggttgccttgagatggtacttgttcccttgaccttgaaccccttgtgggcaggaactggagtggctcatttcactcagcttgcagtctgtggacagctaagtgttaacagctcagcgaagggtcaggctgattgcctcctgtacctgccgcaatgtattctttaatctatgatgtaggttaagagtggaccagtgttctgtttctgactgattatgatgcaacaaatgtaccattaaaatttctcaccgacattggccctgtatcttccatctatcaaggcatgggattgtccatgtataagataggctgcaaaatcctccacaaataaaagtataccccacgggtgcacacaagaccttttttccagttctattgttcatagaggcataagtaagggaaaaattaggagaagtaagaatctcatgatgacagaggaatgttgatccctgattttgggaaagctgtccacatctaggatgtcgtctgcttctggagagaaccttctctggttagctttaccttatgttctccgataggtatacagttctggaggggctcttctgagttgcaagatcacaaacccaaagctcaaagtcacaaagttttgctgcagtgtgggtggcaagtgcaatttttctctgatgttgtttccaaaagtctcaatctctgagttctagatagtgaagtcttcaactgtccttagtcagtggatcatgaaaagtttcctttacctggtgaaaatatactttggcagaatgcatttaaagcattgaaaggctgggtgcagtggctcacacctgtagtcccagcactttgggaggctgaggcaggaggattgcttgagctcaggagttggagaccagcctgggcaacatggtgcaactgagtctctaccaaaaatacaaaaattagccgggcatggtagtgtacgctcgtggtcccagctactgtacttgggaggctaaggtggaaggatgacttgagcccgggaggtggaagttgcagtaagccacgatggtgccactgcactccagtgtaggcaacaaagccagaccatgtctcaaaaaaaaaaaaaaaaaagaaaagaaaagaaaagaaaagaaagaaagaaaaagaaaaaggaagaaagaaagccttgtagcatttagtcacatcagagattaggagtggaagatacatgcgattctattatttggagcatagaccttttagtgactatttcatatggggtcaactcatgttttccactgaaagtggatctgattgttatcaattcctaatgcctttgaccaaggcaatacagttgatttagttagcgtttccagatattattgtatctgtaataccttatttaaccattttacaacttgtctggtgaaacaagtacctccatcactggagatttctccagtaatgtccatgagagaaacacatttcctaataaccttttagctactgttagagcatcagcccgcttacacgggaaagtttctgtaaagccagaaaacatacattgaaaatgacaattgaatgaagtccatctataaatgtttaaatagcccatcaggtagcagaaatatacctgaaattttgattgtcttcccaggattataggtttaacaaaccaaacactggtcataaatttattttagcaatttagaacagtcatcaaattttatatatatatatgattcctgtttggataattttatctcttccatgaggagtcatggagcacagagcttttaataacggaagctttaaggactcaggaaggactagacaaccatccgggctctctatgaatccatgcttaacattaggtttatatcctcttaaatactgattttgtttccccaagtcagatgtatagcactatttgttagatgggttatcataggtaatttgtcttggaccatgggttcattcaaattgcatatctaaacaatttccggactgtctgatttagcatgaaaatctgggaaactattgtcttggtattcaattaattcctctcttgcttgggtgagcagttttatcagtcagtctctttattacagttctgggaattcttacccagtccaaatgatatgattgaaaacttaccagaaacctgtagttaagagtgcctgtcaggaaaaaaaagtgcttgtcagggtcttttttactttttccatgaatctccttgaagacatgatactctaggattttacttcttgagaagagttttcactttatttttaattttttatttttttgagacagggtatcaccctgtcgcccaggctagaatgcagtggtgtgatcacggctcactgcatccttgacctcccaggtttaagcctccctggtagctgggacccacaggcatgcaccaccacacccggctaatttacttttattttttgtagagacaggatttccctatgttacccaggctagtctggaactctcaggctgaagcgattttctgaccttggcctcccaaagtgctgggattataggtgtgagccaccatgccagacaagaactttcagaaactgcatcagaattaagcaattaactatagaaccaacttaattgtcattgttaaagacacaattgacaaatttgttcatttctgtgatctgcagtaatttaacataactataattatatatataaaaaaccatatatatatatatatataaaaccctatatacacacacacacacacacacacacatccagacatatcagaatttggggaatcttatacaattttggaacatatgttaataacattcataaaaacaaaactcaaagttaaacatcattactttttcctttttatttgtttatttaaaatagagacaggatttccccatgttgctcaggctgatctcatactcctgggctcaagcgatccacacttgcaaagttctgggattgcaggtgtaagccaccacgcgtggcctaaacattatttcttatttgacaatgcttcccatgtaatttaacatatcagataagcccttttattatctttcttctgaatgccgcaaggaccctatgatacatcccaaagttaatggtaaaataaaagagacaatttttaatttgcaatttggtttggagaagcctgtcaaatatgttaaaggattaaaagaccttatcaaaataggatcactggtcactgtgataattcagattttaaaaagcaaaaacctttactctttgacagagagaagactccattttccaaacaatcaaaagacctaaaggagaatagcatgagacagaatctgtctctcctgccctttcttttttaaaaaaatttttgcagtttactcaaaaggtgagcaaaaatattttattgtattttattaatactgcatgcaatttttgtttaaaagagaaaaccaggctgggcatggtggctcacacttgtaatcccagcactttaggagcccgaggcaggagaatcacttgagcctaggagttggagaccagcctgggaaacatagtgatatcctgtttctataaagaataaaaaaattggctaatatggtgttgtgtacctgtagttctagttactcaggaggctgaggcaggagtatcacttgggcctgggagttcaaagctgcagtgaggtgtgatcgcaccactgcattccagcctgagtgacagagtgagactctgtctccgagagagaaaaatcagattttattactattattttaacatacaaatataaaatgtggcctgtagtccaagctaattttttttatttttgtagtgataggatctcactatgttgcccaggccggtctcaaattcgtgagctgaagcagtcctcctgcctcagcttcccaaagtgctgggattacaggcatgagccactgcacccagcctcacatttttctttattagcaaatctaaatatatttagcttgtctataccatataaaaaataagatgccaaagcatatcaacttaaacttatgtttaataattaatgtttggtattttaatttatttataaatgactcagacattttatgattattaatttaacataacatgactttaagattttagattactaaaaataattttgaaactctaacacaggtaccctccctaatgtcttccccagtcatcttgggtctcaagtagccatgtggcacccaggatggctaaagagggcagggttcctctgggtccagaatttatatgccaagtttggagctcgggacagaaggcaggtctgtgaaaatgatgcctagaggatcaaacccctcccagaatagccaagaggcaaagatggaccagggaggaaggggcctatattgggcttgattctgccttgtagctagctggtggtctaggtgctgaaaacgtgtccctaggtcttaatatggccacctgtccggattccagaatccaaaagctcaaaaccaaaaacaagctcacagacaaatcaagcaagtatcaaaaatattatagaagcagcagttttatggcccttaaaacatgtattggagacagcataaacctgtttaaccagtagacccaggcaacaatttctgaattatatttaactgataattttgaagtcattgctattatatcaataatttaaaaaccagcttaatttaccaaatattatcacgtacacacaacccatatagacatatagatatacatacagaaagcgatcttaagctttcataaagaatttgtattttctggcttttaaataattttttcagccaagcatggtgcctcatgcctgtaatctcagcactttgggaggccagggtggatggattgcttgagcccaggagtttgagaccagcctgagcaacatggtgaaaccctatctctactgaaactacaaaaattagctgggtatggtggcacatgcctgtagtcccaactacttggcaggggttgaggcagaggatcacctgagccttcagaggccaaggctgcagtgagctgtgattgtaccactgcactccagcctgggcaacagagcgtgatcctgcctcaatataaataaataaataaataaataaataatttttccccactcagacaatcgatcttccaattacctgtttcattgctcaaagcaattgttcactaggcaataatttgccttctgaaaagatgactcagccaggcatggtggctcatgcctgtaagcccagctcttcgggaagctgaggcaggtggatcacatgaggtcaggagttcaagatcagcctgaccaacatggtgaaatcctgcctctactaaaatacaaaattagccgggcatggtggtgcacacctgtaatcccagctacttgggaggctgaggcaggagaatcacttgaactcgggaggcagaggttgcagtgaaccaagattgtgccattgcactccagcctgggcaacaagagcgagacttcatctcaaacaataaaataaataaataaataaataattattcagtgaagacacaaagtttatatctcaaaagcacagagctgagacttgaggtctaaacattgtaccatcatttgtcaaaaccaaggaaaaagggtgtgaaggcccaatttaaaaaaattgggaaggaaaagcaccttaaacaaagcaaagacttgttatgtaaatttaaaacaatggtaagagtttttagtgactcagtcatccctctcagaactcttacaaatgaaaattttcattatagatgtaaatttattttacaaaaatgttttaagatggccagctaaatgtcagaaaggtgtattttggagagggatttagttcaataggtggtctttttaatgtagctactgtttcttagctaaatttactgagttatttctccttctctttgcacattataaaaaaatgaaataaaataaaataaaactactgagttctgggtgaagcccattcaggaattgggcaaagaaaggatttgctatgcatgagcccagcatggatatctctgaaaaggcagcaaacctactttacctgagggcataactttttaattttttttttaagagaagaggtctcactatgttgcccaggctggtctccaactcctgggctcaagtgattcctcccaccttggcctctcaaagagctgggattacaggagtgagctaccatgcctagtcagagggcataccttttataaacactttatccaggatggtttcttttagcctttagggtggaatagtgtattagtccattttcatgctgctgataaagacatacctgagacagggcaatttacaaaagaaagaggcttaatggacttacagttccacgtggttggggaggcttcacaatcatggtggaaagtgaaaggcatgtctcacatggcagtaaacaagagaagagggcttgtgcaggtaaactcccctttataaaaccatcagatcttgtgagactcactatcatgagaacagaacaggaaagacctgccctcatgattcaattacctcccaccaggtccctcccacaacacctgggaattcaagatgagatttgggtagggacacagccaaaccatatcattctgccctggcccctcccaaatctcatgtcttcacatttcaaaaccaatcatgccttcctagcagtcccccaaagtcttaactcatttcagcattaactcaaaagtctacagtccaaagtttcatccgagacaagacaagttccttccacatatgagcctgtaaaatcaaaagcaagttagttacttcctagatacaatgggggtacaggcatttggtaaatacagccattccaaatgggagaaattggtgaaaacaaaggggctacaggctccatgagagtctgaaatccagcagggcagccaaatcttaaagctccaaaatgatttcctttgactccatgtctcacatccaggtcacactgatggtgggttcccatggtcttggatagctccacccctgtggctttgcagcttttgcacccctcctgctgctctcactggctggcattaagtgtctgcagcttttccaggtgcacggtgcaagctgtcagtggatctaccattctggggtctggaggatgatggccctcttctcacaactccactaggcagtgctccaatagggactctgtgtggcagctccaaccccacatttcccttccgcactgccctagtggagagtctcaatgagggccccacccctgcagcaaacttctgcctgggcatcttggcatttccatacatgctctgaaatctaggtggaggatcccaaacctcaattttttatttccgtgcacccacaggctcaacaccatgtggaagctgccaaggcttggggcttgcaccctctgaggcaacagcctgagctgtaccttggccccttttatccatagctggagagactggaacacagggtaccaagtccctaggctacacagagcaggcggaccctgggcccagcccacaaaaccatcttttcctcctaggcctccagacgtatgatgggaggggctgccatgaagacctctgacatgccctggagacatttttcccattgtcttggggattaacattcggctcctcattacttatgcaaatttctgcagctgatttgaatttctcctcagaaaatgggattttcttttctatcatattgtcaggctgcaaattttccaaggttttatggtctgtttcccttttaaacttgaatgcctttaacagcacccaagtcacctcttgaatgtgttgctgcttagaaatttcttccaaaagataccctaaatcatctctctcaagttcaaagttccacagatctctagggcagaagcaaagtgccaccagtctctttgctaaaacataacaagagtcatctttgctctagttcccaacaagttccttatctccatctgagactacctcagcctggatttcattgtccatatcattatcaacattttggtcaaagccattcaacaagtctctaagaagttccaaactttcccacattttcctgtcttctgagccctccaaactgttccaacctctgcttgttacccagttccaaagttgcttccacatttttgggtatcttttcagcagtgccgcactctactggttccaatttactgtattagtccgttttcacactgctgataaaaacatacctgagactgggtaacttacaaaagaaagaggtttaatggacttacagttccacgtggctggggaggcctcacaaccatggcagaaggtgaaaggcacatctcacatggcagcagacaagagaagagagcttgtacaggaaaactccccttaataaaactatcagatctcatgagacttactcactatcaagagaacagcacggaaaacacccccctccatgattcaattacctcccatcaggtccctcccacaacccgtgggaattcaagatgagatttgagtgaggacacagccaaaccatatcagatagtaacaaagtgaaaattagcaaatttaattttttttttattttaacaaaaaaaagaagaagaagaagaaaagagtctcactctgtcacccaggctggagtgcagtggcacaatcttggcttgctgcaacctccgtccttcggttcaaatgatttttgtgcctcaacctccttagtagctgggattacaggtgcctaccaccatgcctggctaatttttgtatttttagaaaagacagggtttcactatgttagccaggctggtctcaaagtcctggcctcacgtggtcttcctgccttggcctcccaaagtgctgggattacaggtgattacaggtggattttattttttaattaattaattagtctcttaaggtttttttatttgcctttcataaattcttttaaaagagccaataacaatactgaatctttttaaagacttttgcacatcaatagacatccctggagccttctttttttttttttttttttttttgagaggggtcttgctcagtcgtccaggctggagtgcagtggcgcaatctcagctcactgcaagctctgcctcccgagttcacgccattctcctgcctcagcctccagagtagctgggactacaggcgcccgctgccacgcctggctaattttttgtatttttagtagagacagggtttcaccatgttagccaggatggtctcgatctcctaacctcgtgatctgcccgccttggcctcccaaagtgctggaattacaggcatgagccaccgcgccgggctggagcctttatttttaaatgcacttcttaaagtgcagtgttgaaatgggagcgtcccctggtccccctcccaggacatgcgacaggggtgtggctctctgttcagccacagcaagctcaaacccctcatgggagcgggagcacacagatgggcaggtgcaggaaccggagtggacacttttgggcttcagccccacggcagtgtctaggggtaactctgtgtcaaaaaattcctgtaaatctctgaaagctgaacttcttactctctgaagtattgccatttactgccagttttctatcatgacttctgaagacagcttggatcaaaaatttgctcaaagaaacttagatagctagaaacccaaattcatggggctttggaatctgagagcttacccacaatccccagttgctgtgagagaggaatggacaaaacaagtccagcacgtcactcatttcgtcactcgacgctcctgggagaccctaggagctccactttggttcctacttctgacaccaaattgttctttgcttaattaatgtttaattggtctaaagttaaatgaaaaactgtagacaaattaaacagattaattaagcaaagaacaatttctgaatcattcagtcccccaaaccagaaaaggttctgtggctgggcgcagtggctcacacgtttgggaggctgagatgggaggatcactcgagcccaggagttcaagaccagcctgggcaacatagcaacatcccatctcttaaaaaaaaaaaaaaaaaaaaaaaaaaagaaagaaagaaaaacaggataggttctgagagtttccagtgctgccgcatggtcagagagaatttatggacagaaaaagcaaagtgaggtaaagtaacagctggattgcgtacagctttgcatttgccttatttgaacacagtttgaacagttggccatatttgattggccaaaactcagtcatttggtatgagggtaggatgtagtctgtttacatacccagttaggttatagttcactatgtacagagaaacatttaggctgaacttaaaatatgtaaggaagcagatttaggctaaacttaattttaacagcttgcttatctatttcagtatctagaattccacaatgccttttttttttttttttttttttttttttttttttttttttttttgagagtctctcgccctgttgcccaggcaggagtgcagtggtgagatctcagctcaccacaacctctgcctcctgggctcaagcaattctcctgcttcagcttcccacgtagctgggattacaggtgtgcaccaccacacctggctaatttttttatgtttagtagagacagggtttcatcatgttggccagactggtctcaaactcctgacctcaagtgatccacctgcctcggcctcccagagtgctggggtaacaggcatgagccactgcgcctggacccacagtgcatttttaacggacctgagttattataaagggctttgctgtactgagccgtggctgtcacaccatcatctgtttctttgattcctctgttcctcattcatgcatcctgtactacactaggcaagacagataaagagcacagatccccaggcttcagcagcctgtgctttcaaacaaggcaatacagcatcttcagtatgagtgcaggttctggagccaaagtctggttttactacccacatttaatctcactattaaatgaaatttatgggaagccattattttggactgagcttctgcaatgggccccaacagaaaagatcaaaccaaaatgaagttattgatgctaaagttatttgtcaccaaaccaaacaactaaactggttttctgatcttcggagaagtcaggagagaaagatgacagccaaatccctaaactggccagttttggtctacataataaggaaattccctatgctttagtctttataagaaaagtaacctgaaggtaactgatctgctttttgtattatgctatttccttgtttttgctcaaactatcttataaaaactgatctgtcatgcccaatggaacatgaaatctttagaggagacactgcccaatttatggttcactaataaaagccaattagatctttttttttttttttttttttgagatggagtctggctctgtcacccaggctggaatgcagtggcgcaatctcggcttgctgcaagctctgcctccggggttcgcgccattctcctgcctcagcctcccaagtagctgggactacaggcgcccgccactacgcccagctaattttttatatttttagtagagacggggtttcaccgtgttagccaggatggtctcgatctcctgacctcgtgatccacccgcctcggcctcccaaagtgctgggattacaggcgtgagccaccgtgcctggcctcttttttttttttttaagacagtcttgctgtgtcacccaggctgaagtgcagtggcacaatcttggctcactgcaagcttcacctcccaggcttaagtgattctcctgactcggcctcccgagtagctgggactacaggcatataccaccacccctggctaatttttgtatttttagtagagacagggtttcactatgttggccaggctggtctcaaactcctgttctcaagtgatctgcctgccgtgacctcccaagtgctaggattacaggcatgaaccactgcgcctggccacatctttaaactaaatttgttgaaattttgttttttaatgtcactaaactgtaagaaagagaaaaccaggagctggcctgtcagtcactgccaggccttggtgttctgtggaacatacatgttttcacagaataacaacattggacaagactgctgtaagaccacaatggaacaagacaaaagcaagtctattccccaatcatgtctgagcacaaacaaaaccaagaacatgtctaaacctcaaaaggaccaaacatacccttaggctggctgatatgagtcacaagctgtctttaccaattataggtatatctctactctagatttcctgccttctagcaaaaacattattaagattccacgtcatagtactcgtacctttgcttcctgacgacactcaatccagagcaaagctctgcttccctgaaccctctccaaaatgatcttacagaagccatatttgccatttttaattaattaatttatttatttatttattatttatgagacagagtttcactctgtggcgcaggctggagtacagtggcacgatctcggctcactgcatcctctgcctccaggttcaagtgattcgtctgcctcagcctcctgagtagctgggattacaggcacctgccaccacatccggctaatttttgtacttttagtagagacagggattcaccatgttggccaggttggtctcgaactcccgacctcaggtgatgcccccacctcagcctcccaaagttctgggattacaggtgtgagccaccatgcctggtcagtatttgccatttttaatacctgtattttgctgggatatgcctcacaccagctaacccaggatgtgcatgtttctggaagtccttgagaagaaccttcgatgtgctataatcctaagggtaacttgcctgcattgctccctagtggtctgaggtttcagctgagatagtgagggtggagaggggcgggtgtgatagtgatggaaacacaccccatgtagatcagaggcagcagaagagggcagggagaaagttgagacctggctttgctgtatactactttgtaaggccctgaccaaggctggtgatctctctgaaccttgtagttcttcctctaaaatggagcttccttcttcaggggactggtaagaattaaaagcacaaagtacataaaaagctttgtagaactggactctttttcctggatcctggtaccaaggcaggatcatgactttcccaggacccttagcaaaatgtcctatttaacttttttttaaaatgtaaaccgatttttaggtagggtgtgctgtctcatgcctataatccaagcattttgggaggccaaggcgggaggctcacttgaggtcaggagttcaagactagcctgggcaatatggcgagatcctgtctataaaaaatgaaaaaatcagccaagtgtggtgatatgtgcctgtagtcccagctactcaagaggctgaggtgggaggatcgcttgagtctggatgtttgaggctgcagtgagccatggttgtgcctatgggctccagcctaggtgacagagtgagatcctttctcaagaaaacaaacaaacagataaaaaacacacacacacacagctgctactctggttgaagtaggggaattacttggaattctccctccagggaccaccacccccttacatgcatcctttttttcttttatgtccctggggacatagcccaaaagttcctggtttatacattgtgctattcaaaatgctgcagtctcccacaaatgaaatctaattccgtacacgtcattaggtctcatagatccaatcctgttatgtaaaagttgagggagttacacagtccttttatgaaacaagaatttgtcaaatcaaatgttgcttcagtctttgcagtggccctggctgccacgagattcaccctgcagtacaaagtgctccagaaaaccacttacatgagctgagcctcctgagctgccacgagcttctggggcacacacttcagaaacatcctcatgtgctttgcactcaccccctgcttctgttgttttggtgattgctgcacatacattccaaaaagaatcacttacatgtgttacaggaaaggggtcctgatccagacccccaagagagggttcttggatctcatgcaagaaagaattcagggcgagtccacagagtaaagtaaaagcaagtttattaagaaagtaaaggaataaaagaatgactactccaggccgggtgcggtggctcacgcctataatcccagcactttgggaggctgaggcgggcggatcacctgaagtcaggagttcgagaccagcctggccaacatgacaaaaccctgtctcaactaaaagtacaaaaattagccgggcgtggtggtgggcatctgtaatcccagctactcgggaggctgaggcaggagaatcattcgaacccggcaggcagaggttgcagtgagctgagattgcgccactgcaccccagcctgggcaacagagcaagattgtctcaaaaaaaaaaaacaacaacaacaacaaaaaactgaccctactaagggctgctgcttgcccatttttatggttatttcttgatgatatgctaaacaagggttggattattcatgcctcccctttttagaccatatagtgtaacttcctgacgtttccatgacatttgtaaactgtcatggtgctggtgggagtgtggcagtgaggcataccagaggtcactcttgtcgccatcttggttttggtgggattttgccggcttttttactgcaacctgttttatcagcaaggtctttatgatctgtatcatgggctgacatcctatctcaccttgtgacttagaatgccttaacagtctgggaatacagcccagtaggtctcagtggcattttacccagcccctactcaagatggagttgctctggttcaactccattggacgagatttacctccattggatttacctctccaagttgccacctgtaaccctaggatcagtattatgacatttacatgaccaaccttcccaatgcctgcacaatttgcctattctggaaaaacttattttaattttttgtttcctgtggggtttctttctttgttcttctttttttttttaagtgagtggttacttctaatgtatatgtatcaataacttttatcagcttatctcagtatacagtgacaccatgaaagtgaatgtgaatgccaggcacttcataagagaatcagttacttgaccaactgtattagtcagggttctccagcggaacaggaccaataggatatatgtatatataaaaaagggtttattagggagaattggctcacattgattacaagacaagtcctaccgtaggctatctgcaagctggggaaaaagagaaggtggcagcctggctcagtccaagtctgaaagccttaaaaccagggaagcccaagtgtagccttcagtctgaggctgaaagcctgagagcccccaggatgctgctggtgttaagttccagagtccaaggcccaacaaactgcagtctgatgtccaagggcaagaggagaggaagcaagcattggcacaggaagacagagagagcacgctagaggacatagccagctgaatatcccttcttctgcctgctttgttctagctatgctggcagcccattggatggtgcccacccacattgaaggtaggtcttcctctcccagtccatttactcaaatgtcaatttcctctggaaacaccctcacagacactcccaggaggtgtttcaccagccagctggcatccctcaatccagtcaagttgacacaatattaaccatcacaccaactttgttgttaccttgtatgctaggcagaataatgatcccccaaacatggtcacattctaatccctggaacctgtaaatatgttatgttttatggcaagacggaattaaagttgcagatggaactaagtttgctgatacactgagtttaaaatagggagattctcctacattatttgggtgggcccaatgtgagaacaagcatccttaaaagatgaaaagagaggccaaagagtgagtgtcatagtgatacggtgtgagaaaaacttgaccagcaattgatagcttagacgatggagaaaggggccacaaaccaatgaatgtagacagcctcttgaagctagaacacgcaagaaactggatcctctcctagagcctccagaaaggaatgcagctctgctgacaccttaacgctgagtgagacccattttggacttctgacctccagaactatgacataataaacgtatgttaggtgttttggccagacgcagtgactcacgcctgtaatcccagcactttgggaggccaaggtgggcagatcatgaggtcaggagatcgagaccatcctggataacacggtgaaacgccatctctactaaaaatacaaaaaattagccagacgtggtggtgtgtgcctgtagtcccagctactcaggaggctgaggcaggagaatggcatgaacctgggaagcggagcttgcagtgagcagagatctcgccactgcactccagcctgggtgacagagcaagactctgtctcaaaaaaaaaaaaaaaaaaaaggtatgttaggtgttttaagccgctaactttctggtaacttgttacagcagcaatagaaaactaatacagctcgatttttttcattgggttcctcagcatcattgtaagacatgaattctaagggtgtgttgagagcaaggttcagatatttagcagagtaggagaaaaggaaataatcgaggctctggccctcgccgacacaaattttcctagtggatatagacctattttttcacaaacgtaagtgcaacagtaaatttccaaagccccgtagaaaatttgtcagtctctgatgttctgaataacatacagccatacccgcactgtaaagttactaatctccctccccatcccttgccatactgtgctctttcgaaggaagtcactctgtgcaacccgcacttgaggagtggtgctacggtttgagtgtccccttccaaactcatgttgaaatttcattaccaatgtaattaagaggcaggaccttcaagaggtgattaggtcaggaggactctgccctcatagtggattaatgctgttatttcaggagtgggttagttatcccaagagtgggttcctgataaaaaggatgaagctgaccatcagctgaataagatatagttccagctacttgggaggctggagcaggagggttgcttgagcctaggagttcaaaaccatagtgtgctatgattcttgtgaacagtgattgtactccagcctgggtaacatagtgaggccctatcttttttttttttttttgagaaagagtcttgctctgtcactctgtccctaggctagagtgcagtggcgtgatctcggctcactacaacttttgcctcccaggttcaagtgattctcctgcctcagcctctcagggattacaggtgcctgccaccacacctggctaatttttttgtatttttagtagagacaggggtttcaccattttgaccaggctggtcttgaactccttacctcagatgatccacccaccttggcctcccaaagtgctgggattacaggtgtgagctactgtgcccagccacaagaccctgtctttaaaaaaaaagaaaaaaaagttgagtttagccaaatttcctctctttatccatgttcacttgcccttctgccatgttatgattcagcacaaaggccttcactagatgctggtgccatgctcttggacttcccaggctccagaaccataagccaaataaacttctattgtttataaattgtccagtctgtggtattctgttatgcaccagaaaacagactaagacaggtggggaattatgcttccttttctttagggtggagtatctaatccctttgcattggaatccctctgcatgagagatttgtctcatctcccgtatttattattcaatctttttatatcaatatggactcctgggtatttattttattctttagcttataattcaatattactttattttgttgtgcaaattattccagtgtcagccatttggagcacttgttgtttcctttgcccctttgattaatgcccatcattgtgttttgtttttcttttcatttctggcactataagataaatcctgtgtatatttcatctcaaacattgtattttttatatctagaagtttaatttgggtcttttaaaaattatctccttttttttttttccaagatggattcccactctgtcgcccaggctggagtgcagtggcacaatcttggcacaacctctgactcctgggttcaagcgattctcctgcctcagcctcccaagcagctgggattacaggcgcccgacaccatgcctggctaatttttttgtatttttagtagagacagagtttcgctgtgttggccaggctggtctcaaacttctgacctcaggtgatccgcccacctcggcctcccaaagtgctggaattacaggcatgatccacaatgcccagcctcctcttctggctgggcgtggtggctcacacctgtagtcccagcactttgggaggccgaggcaggtggatcatgaggtcaggagatcgagaccacactggccaacatggtgaaaccccgtctctactaaaaatacaaaaaattagctgggcgtggtggtgggcgcctgtagtttcagctacttgggaggctgaggcaggagaatggcgtgaacctgggaggcagagcttgcagtgagctgagatctcaccactgcactccagcctgggcaacagagcaagacttggtctcaaaaaaaaaaaagtatcttctatttctctacttaacatgttcaattcttcctctagcttcttcagcatatggaatatagttataataactgtttttaaaaccttttctactaattctttcatctcctccttacaggtcatattttcctgcttctttggaagcccggtaattttttttttcacagggtctcactatgttgcccaggctggctttaaactcctgggcttgagtgatcttttcacctcagcctcctgattagctaggactatagacatgcaccacctcacctggcttatgcctagttattattattattattattattattattattattattatttgtatcagattcttgctctgttgcctaggctggagtgtagtgtcatgattagggctcactgcagcctccaccttctgggctcaagtgatcctcccacctcagtctcttgagtatctgggactataggcacgcaccaccatgcctggctaatttttgtaatattttgtagagacggggttttaccatgttgcccaacctggtcttgaactcctgggctcaagtgatctgccccttgggcctcccaaagtgttgggattataggtgtgagccaccacccctggccaaattttttaatttttttgtggagacggggtcttgccatattgccagggctggtctcaaactcttcggctcaagcaatccttccgccttgccctcccaaagtgctgggattacaggcatgagccactgtgcccagcatgcctggcgatttttaagtggatgccataatttttaccttgtaggatgctggatatctttgtatttccaaatattcttaagctttttacctgggatgtgattaacataattgaaactagtttgactctctcttgggtcttattttaaaactttgtctttttaaacttttaaactaagaccagagtggtgttttgtgtaggcttcatgtttccccactagcaagcactcagaactctccctgattgcctgtgagttatgaggttttccacttgggtggtggaagctataggaattgttgtctttaaccctttcagcctgttctttcctcaggctcaggtatttatgtcacacatgtgctgattagtacttaactgaatactcaaggccagggctgtctgcagttctccagcattttctcttacatcgctttcctttctggtactctttcctgttgactctagctgtcttgccctcactggacttccagctccatctcctcaattcagtgagcctgctaggctccacctggattgccccagctgctaatatttctccagcaatcatggggatcgccttgattatttctcatctttcaagaatttctattctaccagcctaggcaacataaaataatttttaaaaatagcagggtgtgggccaggcgcagtggttcacatctgtaatcccagcactttgggaggccgaggtgggtggatcacaaggtcaggagttcaagactagcctgaccaacatagtgaaacccagtttctcctcaaaatacaaaaattagctgggcgtggtggcgggcacctgtaatcccagctacttgggaggctgaggcagagaattgcttgaacccgggaggcagaggttgcagtaagccgagatcgcaccactgcactccagtttgggcgacagagcaagactccgtctcaaaaacaacgccaacaacaacaacaaaatagctgggtgtggtggcaattgcctgtagtcccagctgcttgggaggctgagatgtgaggatcacttgagcccaggaggtcaacgctgcagtgagctatgatcgtgctactggactttagcctgggtaacaaagtgagactgtctctgatatggtttggctgtgcccccacccaaaatctcatcttaaattgtaatccccattatccccacagtccccatgtgtcaagggagagggggaggtaattaaatcatgggggtggtttcctccatgctgttcttgtgatagtgagtaaattttcatgagatctgatttttttttttttttttttttttgagacagagtctcactctgtcacccaggctggagtgcagtggcgtgatctcggctcactgcaagctccacctcccgggttcacgccattctcctgcctcagcctccctagtagctgggactacaggtgcccgccaccacgcccagctaatttttttgtatttttatagagatggggtttcaccgtgttagccaggatgatcttgagctcctgaccttgtgatccgcctgtctcggcctcccaaagggctgggattacaggtgtgagccaccgcgcctggcctgatctgatggttttataagaggctcttacccctttactgggcacttctccttcctgacaccttgtgaagaaggtgccttgcttccttcccctttgccttccactatgattgtaagtttcctgaggcttccccagccatgctgaactgtgagtcaattaagcctctttcctttacaaattacccagtcttgccaggcacgatggctcacacctgtaatcccaacactttgggaggccaaggcgggtggatcactaggtcaagagtttgagaccagcctagccaacatggtgaaactccatctctactaagaatacaaaaattagccaggcatggtggtgtgtgcctgtaatcccagctactcgggaggctgaggcaggagaattgcttgaaatcgggaggcagaggttgcagtgagctgagatcgtgccactgcactccagcctaggtgacagagcaagagtccatctcaggcaacaaaaataaataaataaattacccagtcttgggtttgtcttcatagcagtgtgaaaatggactaatacagtctctaaatacaaaagaaagaagaatatatcttttgttgcctggtggtcagtgtcttgagaaacatttgctatatgatttcccttttctcggttgtttcagtagaaagagtaaatctagtccctgttattccaacctggccagaagctgaagttcttggccccaacagtctttttttttttagatggagtctcactctgttgcccaggctggagtgcaatggcactatttcagctcactgtaacctctgcctcatgggttcaagtgattctcctgcctcagcctcctgagtagctgggattacaggtgcccgccaccacacccagctgatttttgtatttttggtagagacggggtttcgccatgttagtcaggctggtctcaaactcctgacctcacgatccgccctcctggtcctcccaaaatcctgggattacaggtgtgagccaccacgcctggccgacccccacggtttttttaaatgagtggctacttttacatatactagtcactttaatcagtttatctctgtatatggtaaaactattaaggtgactattaattctaggcactttgtaagaggtccttccaccactacctttcatcttgttttccatagcagctgcacttacattcccaccaaaagcgcacaagggttcgtttctccaaatccttgtgtaattcccattccttttaaaatagttttaacatatttgctttcgttttttgttcttgtttttgagagacaaggtcttgctgtgttgtccagtctggtcttgaactcctggcctcaagtgattctcctgccttggcctccgaaagtgctaggattacaggcaggagccactgcacccagcccacatttattttacaatctctttataaattatgctattgtctcaagttattgtgggtgctaattttcctgtttattaggtcgctgatggttaaatatggtagatcgtttccttgactactttatgtttttctgttgtgagcattccatttggcttgggttgtaacgatgtctctacagagaagttgtgcatggatattacttgcccaggaccaatttttgcactgctttcttagctgaagctatcaataccaggagggcagcacaaatccctacaaatctaatctacaaatagggttcccaaatccattcacagtgtaggcttacagttttgattttccatggttgacttgccctgatcctcacttctatgcatcccaggcagagacaagcttcctttctatttctctggactgttgtactgaacagtttctagaactctcttcaatgaatatatagtctgggaggagtatccagtctttttttttttttttcctccttaagacagcgcctcactcggttgcccaggctggagtgcagtggggcgaacatggctcattacaagcttaagtgatcctcctgcctcagccttccaagtagctgggaccataggaatgtcaccacacccggctgatctttttatgttttgtagagacatggtctcactttgttgcccaggctggtctcgaattcctgggctcaagctatcttcccacctcagcatctcaaagtgctgggattacaggtgtgagccaccacacccggccccccagtctttatacatgggcttcagttccaactctcagggccacatggacccaaggttccatctcccatcattacatgtgtagtaaaacccaagtctctagcagctgggtcctgtctgtatccaacaaccacctccaggacaagagagacatcaggccacatcttattgctctggttccctttttgtttttgactcctgaggatttcctcttacacgttcagcaatgaatttacttttttttttttgaaacggagtcttgctctgtcacccaggctggagcgcagtggcagaatctcagctcactgcaagctctgcctcccgggttcatgccattctcctgtctcagcctcctgagtagctgggactacaggcgcccgccaccacgcccggctaatatttttataattatagtagagacagggtttcaccgtgttagccagaatagtctcaagctcttgacctcgtgatccacccgcctcggcctcccaaaatgctgggattacaggcatgaaccaccgcgcccggccagcaatgaatttactttctttccctgtgtgcttgcttgcttcctttcttgtaatataataggcagggttttctggtgtttgtgttagaaaaggttcccagccaggcgcggtggctcatgcctgtaatcctagcactttgggacgccaacgcaggaggatcccttgagcttaggagtttgagaccagcctggacaacacagggagaccctgtctctattttatgtaactacatttaaaagataaaaataaaaaaagtttttaaaacgttccatactagctcagtctgacgttggaaccagaagtgtttttatacataaagggcacatcctgatgatttccctaaaaatctgcagacagtctcaatggtgaatgaaactctattgtaggaacagaatggtgtgggctgcttagaaacaacagttttcttttgtttgtttgttttacatacagggtcttgttctattgcccaggttggagtgcagtggtatgatcacagctcactgcagccttgacttcctgggctcaagcaatcctcccatctcagcctcccaagtagccaggactataggcatgtgccatcacacccaactaatttttaatttttttgtagagactggagggggtctgtcattgatacaggagtggggcagggaagtgctgggtagagaaaggcagggtccctggtgagggccccacccatggacccaggtgaagacaggcactcctgtttttgtgcccaaatgttgcattttccaagaccactctggcccgcacaccccccatcttgtgcctatataaaccccaataccctagtgggcacacatacaaatggctggatatggagaggaacacatcagaagaacacacggacgctgacaggccatcaactgcagaaggatgcggatgcctagggaaattcagctgagggtggttgaaggagagccaggcaactccaggggaagaccaccttcccactccattccccttctgtttccccatacatctgctgagagcaacctccaccattcaataaaaccttgcactcattctccaagcccatgtgtaatctgatttttccagtacactagggcaagaacccaggatacagaaaactctctgtcctttcaataaggcagagggtctaattgagctgattaaaacgagctgtctacggacggctaaactgaagagcacacagtaacacacgtctactgaggcttcgggagctgtaaatactcaaccctagatgctgctgtggggttggagcccacgctccccactacctgcccgtctgtatgctccccctagggtttgagttgcagggcactgaggaagcaagccactcccccgctgtcacacaccctgctagggggataagggaacttttcttgtttcattactatgttgaccaggctggtcttgaactcctggcgtcaagcaatcctcccacgttggcataagtgctgggattacaggtgtgagccactatgcctggcgtaaacaacagtcttctcagtgctttgactcatcaatatttcaaaatattttgggtccatgcttgagcagggggttaacatggagaagacaatgggggctgtgaacttgtgaagagggggctatcacttgaggggaggactggacttgcttacttgctcctgaaggcagactggtactggaaggggaaactctggcttcatgaggcagaaacttctccaaatcatattaacgtggtagcagctcttcaccccaggatttggtgatcttgatacctggtttgtttgtttgacccctgttcaagccaacaagccaggtatcaagaccacaaaaatacagtttttttcttgggtgaggagagagattttttgtttgtttagacaggatttctctctgttgcccaggctggagtgcagtggctcactcatggcccacttcagccttgagctcctggactcaagcgaccctctcacctcagcctccctagtagctagggaggactacagttatgcgccaccacacccagctaatttttttttttttttttttgtagagacaggattttgccatgttgcccaggctggtctcaaactcctgggctcaagcaatcctcccacctcagcctcccaaagtgccgggattacaggcgtgaggcacaaaaatactgtcgatagccagaaaaataatgtcttagcaactcacatccatgttagttgtttgtttctaggtcttgctagctcaaattccacttatccgtcttaatcaccatctaaaagatgcctttgtttttgagaatccatgtgtttgtgtaggttcaccactttcttttaatcttctgaatacctaaaataaacctttgaaatctagatcacgcacagtctaggttgagatgagagaatactgagcggatggttgtgtatgtatcaatgtgtagaaaaaggcatccatcgttatggcaaccagcatccttaactgatgcaatcctgttcccaataatatgagatgtgattaaaaattgacattgcagcaaggaagaacacatgcaatgcgttggcgtggcaaccggaatagttaaattctgcataaatttaaacctgtcgatcacagcaatttggagaatttgcctacatttcattaggaacccttttctcatctggcctgggagggaatcaggagcctggtggtctgacatgtggccatgacttaaggccaagtaaaatcaagggattaaattaaatcattggtgtgggagaggggctggatggtggactgtaccaaaagttaccctgttttcatctgcataccctacatcatttagtcactcaacagatatttattaagcacccactctgtgccccgctctgggctaggtactaggaatacaaaaactaatatttcctaccctcttggagcttgaaacctcttagcctctggaattactcaaatctatgtgaagtgccagctgtggtatgtgtaagcgagacaggtatcttgtgttaccagaaccaataacaaggagatttgattaattagagagatcaggtggaggcgaagagatcagtcaaagtgaagcagagaggggcagtgattgctacaccaccacaggaacccaaactgaaaacgaccatacgccatgaagtgggtgatagtctttaccaatgtcgaaatggaggacctgggggatactgatgttacccagcccttcgcagtggggtcacccaaaagtagacgcggctaatgccgctctttatgcccggcagggccaggaccagagtccccgcacgagggttcctctctccggtcgcacgtgcccttcacccttcctgaggccgttttctgacgctcctgagctcccctccagggtgagggcaggcgcggtgggaaggcgttggacagagcagacactcggctggggtgcatgcctgggtgcagcctcgtcttttgtcactaaccactcagctcggtagccctccaggctctctcttcgagctccgcggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcggcgcccggctcggaccgtagctaggcgctgggcggccaccggctggccaggcaggtaagcaaccagcggtgcgtgggctcagaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaagagtttttttattaatggaaaggtgtggagggcggggttttggttttcttgggaaatgaatgagtcatttggcaaactttcctaccattaattttggatttttataatggaatatggaattttttttgtttctctctctttttttttttttggccataaagagaaagaataaaaagaattccgccattttagcgttttaaaaagtaaccgttctgcggaactgtcggatcagtgaccgccccgcccgcctttgcctataccagtcccgggaggctggtggcgggtcccgatcctggaaccctgcgctcagggccgcttccgtcccctcccgagtccgggaagcagctgcggcgaggggcggggccgaggccccaagtttgtagcgctcagccttgctgtgtgttgttttctgggtagctgtcgagggctctactccccacccaacacctatagtaaggacatttattggtcgtttttgtatacaaggccttggaaggcaagggattgagaaaaccttgtcagacatcaagagaaaatacccatggacacattcagccaacagatatttattgagcatctgctatgtgcacggctctgggctggggctacaatggttgttttaggtcgggtcccccgaaacagactccgatagcaagatttgagtgtaggtttatcggagtgctcttgcgaatatcaccagtaggggaatgacgggttgggcggaagaagaagctgaactgctgatgtagtctcaacagaggcctcagcctgacctaatggaagctctggaactgagatggccctgcagaggtgttccaaagtaaggcaagggggtggggtctttacacctcatagcaactcgtcattggctggcggcttctaggagagccttcaagtgaggtagctccctaggctcagagcagttccaagagaggctgacggcagaaggctgaaaactttcttcagtgtccaccagaaacccagactcttctgagtcccccctcacttcatggcagactccttctcagtcccttttgctagacccttttcctcttcccaacctataaatgtgggtgtgctccaaagttcccacttttttctttatactcagttatgtggttttttcttttttctttctttctctctctctccttccttccttcctcccctcccctcccctttctctctgacagggtcttgctctgtcgcccaggctcgagtgtagtggtgtgatcatagctcactgcagcctttacctcccaggctcaagcaaccctcccacctcagcctccccagtagctgggaccacaggggtgcaccaccatgttcagctaatttttaaaatcttttgttgaggctgaggcctcactatgttggccatgctggtctcaaactcctgggctcaagtgatcctcccaccttggcctcccaaagtgctaggattacaggcatgagccaccaggcctcgccccagttctgtggttttaaatgccatctacacatgctggtcttcaaatttatacctccagccccaacctcatccattatctccagaatataagcttcatgagagcattttgtcatgtttgtgactgtaaccccagagcacagaatggtggtgacacctacttggtcctcccatgcttgctggaaaagaggcagcgaacccaaacagaaacgtagtcttcaaatccagcttcttcaatagacctgagatgtgacaggttttgacacagagtgaaattctttcagaagtaaccacattcactcttaactgccagtgtttcaaataaaaagattaactctatttatttatttatttattgagacagggtctcattttgtcactcaggctggagtgcagtggcgcgatcttggctcactgcaacctccacctcctgggttcaagggattctcctgcctcagcctcctgagtagctgggataacaggcgtgtgccaccatgcccagctaaatttttgtacttttggtagagatggagtttcaacatgttgtccaggctggttttgaactcctggcctcaagtgattggcctcccaaagtgttgggattacaggtgtgagccaccacgcatggcctgcctggctaacttttgtactttttgtagagatggggtttcaccatgttgcccaggctggtctccaactcctgagctcaaagcgatccacccaccttggcctcccaaagtgctgggattataggcgtgagccaccacgtccagcctaactctaaaggtatttaaaatagtacaagtacttcagctgtgcaaagcaaattggaattgaaattcagggaattatgttttataattttctttctttctttctttcttttttttttttttttgaggtggagtcttattctgttgcccaggctggagtgcagtggcatgatcttggcttaccgcaacctccacctcctgggttcaagcaattctcctgcctcagcctcccaaatagctgggattacaggcgcctgccaccacacctggctattttttttttatttttttgtgtttttagtagcaatggggtttcaccatgttggtcagactggtcttgaactcctgacctcaggtgatctacccacctcggcttcccaaagtgctgggattagaggcgtgagccactgcgcccagctaattttttttttttctttagagacagggtctcgctctgtcacctagaccggagtacagtggtgagatcatggctcactgcagccttgacctcccgggctcaagcaatcctcctgcctcagcctctggagtagttgggactacaggcatatactgcaacacctggcttatttttattttttaattttttatagagacagagtctccctgtgttgcctaggctggtcttgaactcttgggctcaagcagtcctcccacctcagcctccagagtactgggattacaggtgtgagccactgcattgggcccatacagtgtttttttgttttggttttggtttttggtttttgagatggagtcttgctctgtctcccaggctggagtacagtgggacgatctcggctcactgcaacctctaccctccacctcccgggttcaagcgattctcctgcctcagcctccccagtagctgggattacaggcacatggcaccaagccggccccatacactgttttttattaacaagttcaagttactgaaatccaacacaaggacttattaagcacctactatgtgccaggtactaagtgttggggatacagcaatgaataagacagacggtcagcatttatgtggagatgactgatcaaacacagaaataaataattgaagatcactattgattataatgaaggatgagaaagaaagaaatatataatagtaatgagacagatagtggtgggatggggtgaggggtgtgctgctgctttaaattccttggtcaggccggactcgatggctcacgcctataaacccagcactttgggaggccgaggtgggcggatcacctgaggtcaggagttccagtccagcctggcaacatggtgaaaccccgtctctactaaaaatacaaaaaatagccaggctatgtggtatgtgcctgtaatcccacctagtcaggaggctgaggtaggagaattgcttgaacctgggaggcagaggttgcagtcagccgagatggcaccactgcactctagcctgggcaacagagcgagactccatctcaaaaaaaaaaaaaaaaaaaattggtaaagaaagacctcttctgaggaggtgactattgagttaaggcctggaggatgggaaggagccagtcaagcagagagcttggggaagagcattccagagggagggaacagcaagggcaaaggctgtgagtgggaatgttggtcaagcaatagaaggaaaccagagtctgttgagtggagagaacaggggaagagtggtggaggatgaggccagagggaaaagcagaggtcagattttctagggcaaagtgctttgattttactgtaagggcaatagagagccactgaagaatttagatagggaaattatgtgatttggtttatgtttttaaagctttttcgactggagagtagactgtaggggtgcaggaaaggaagcagggagatgggttagaaggcaatttcagaagtccaaagagagctgatgttggctgggactagcatggcagcaatggagatggagagaagtggttagaccttcagtgtgttttggaggtagcactgacaggccaattttaatacgtctaaagctgtgctgtccaatacaatagtcatagctactgtcgctatttatttacttatttcttgtcagagacagggtctcgctatgttgcccaggctagcctcaaactcctgggctcaagccatcctcccgtgtcagtctccagagaacttgggactacaggcatgcaccactgtacctaccttctggtcactatttaaatttaattaaaattaaataaaataaaaaattcagttcctcagtcatagtagcccatttcaagtgctcaatagccacatgtggctagtggctacggtgttggacagtttaagtattggacattctcattatcacagaaaattctactggacagtgctggtaaggcaagtaggacagtggtcagtacattttaggtgctgagtaaatagatattaagtatattctttgtatctctaggtctttttctttatgtctttacctgttgaatgaactctgtgaaatgcttctactgcctttgcgttattaaaacaaaatcacgtactgacttgactgcgtcttcgtacactatgtctctgctcttcagatgcatacatttgttcagcagatgcttgagtgcccaccctgtgcttggggttggagggagtggtggacagggccataaaagaacatgatcaggaaagatcccacctcccaggaagatgaaccctgtatgggtgaaggaaaacctggtacttgaggtctctgaatccccagagggaggagggagtgattccagtggggatagaggtggggtcaagaaaaaggtgagtttggatgtggcctgggctatgtcctggagacaactggccacacagaaccttgacctgagtcatgctccccagagtcagttttgtacatcacagtttacaaagtaccctcacacatgccaccctacccatccttaccatccttacagagactggggaggtgcagggcctggccagaacaggagccagacctgatgctggtctctgaagacaccctactccccacaggactgaggcctttctctgcaggtcacgggtttgaaggtggctagcttctcaaagaagccccatcccttcacatctccattgctgctgtaacaaaggtccccacctgatcaccctgggggctatgtttggcttgtaggcctgccaggatggaggggcatgctgggatggaggggcatgctgaaatggagatgctgaggacactgaaggggccttccacaggggaggtcagcatgcacttggtggccggagacagccccggttctggtcctcacctgcccgcaactgccttcatcattccaggtgagtcaagctagggtaggagtctgggaaggaagagcatctctgtacctgctcaagcaagtgtggatcctggagaggggatgaccgttttcactgtcctccacctgccttccttcacatgcctacacatgcatggccggattgaggtagggccactagactcacctgtgtcgtgtctatttgtatatctgtttacagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcgggtcagtgtctgtggggattggctaagcctcgtaaaccgcagccatggggcggggcttgcaggcccggaggctggacctgagacggaagtgggggaagctggctcagatgatgggccctaggggtgggctttgagtgagggactctcggggcgtggcttgagttgaagcactcctaggccctggggactatgggggcgtggcttggagtgaggcactctgggactgggcctgtgggtgtctgggggcgtggcttagactggggcaccctgagtgggcctgtgttagtttgggggcgtggcttagagtggggtaccgtgggactgggcctgtgggagcctgggggcgtggcttagagtggggcaccctgggactggaccccgcaggtgcttgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcgggtaggagccccgctccccaggccctgagctgggccctgtgcgggtggggcgaggcctgagccccagaaggttcgggggcggggcccggggtggtcctggggtggagaaggctggaggaggccatccgatgcggagatggaccgaggcggaggcagggcctgagggggcgtgggcggagcctgagtgtggctgcgatggggagggaggcctgaggcccatttggcccccgcagaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtaaggggaggaggtcgcagccctacttgctctaccttcagcccccaaagcctcattcctgttcaggggttaggagaggggctgggtggtgcagggcgggtggttctttccctaaggctggcccttcctcaggtcagtcatagtggagaactcctcaggctctaccagcgcttctgagctcctcaaacccatgaagaagaggaagcgcagggaataccagagcccatcagaggaggagtcggagccagaggccatggtaggaagagggcagtggggaagggagggggaagctatagcctatgcctcaattcccactgtcccctccatcaatccagattatggagctgggccagagaagacacgcataatgactcactcatcatattttggggtcccatcctgagttaggtcctatacctggttaaagggaaatgaattaatcactctcttgattttccagagctcccatctcagtttagtgtcaaggttaagacatagtcaggtgaactagcacccaaagtacatgtgcaggcagctggaaaactccatcactggagtccagtgcctaggccaaaggccagggaacacccagggctctagctgcagaagctggaagggacagagcatgaattctactgggcgtgtaagagcatcacaaaggaagtttttgtgtactcagtttctctaccagataataaggagagttgtagtcaggctgtttaattaggatgtgcatgctcatgtgagtctgtgctcaagtgatagggggatgtctgctggagctgcactcctgctggcggcctagaagaaattctgcctgtttggggcagaacaccacatggccagagagccaggtaggggccaggatcagaccctagggcttcatcccaaaccatgaggagaagaagctgggatcaggcttgccttctacaggagaagcaagaagaaggaaaggacccagagggacaacccactgctagcaccccagagagtgaggagtggagcagcagccagcctggtacggtggcttgtgtgtatatatattcgtgtgaggtgtgtatatacctttggaggtgtgaggctgagaatgtgggttatgattgtgatggtaggttgtacatgcataaatgagcatgagttagtgtgtgtgaaagagagagagacagtgagagactattttgggtttgtgtattagtgtatgtattttcttgggagttatatgatgtgtttgtttatcctctattatccagtcatgactaggccccagtgccagggagatcttggctcaatttttgaagacttgagtaacttttactggcaccacatgtcattgcttctctttagtggtggggcaagcctgcactggtcattggtctaacattcctgtttggaaccctattctcactctttgattctaagaaaaatggagcagaggtcattcatatctccaaccttcaggccttctcaattaccatctccacattcccacatgacaactgtcaactgtagctaagtagcatacttgtaatcacatagatactgtgtagcagtttgtttaatgtctctcttctgccctcaaaaccatcaacacaaggacagtatctgtttttttttttcttttttaaaattttttaaattaaaagttttggagggtgaccgggtcttgctctgttgcccaggctggagtaaagtggtgcaaacacagctcactgaagccttgacctcctaggctcaagcagtcttccacttcaacctcctgagtagctgggaccacaggtgcatgccaccatgcatggctaattttttaaatttttgttatagagatggggatcttactttgttgctcaggctggtctcgaactcctgggctcaagcagtcctcctgcctaggcttcccaaagttctgggattacaggtgtgaggtaccacgcctggtcgtctttttttttttttctttgagacggagtttcactctgttgcccaggctagagtgcagtagcgccatcttggctcattgcaacctccacctcttgggttccagcaattcttctgcctcagtctcctgagtagctgggactacaggcacatgccaccacatgtggctaatttttgtgttaatagagacagggtttcaccatgttggccaggctggtctcgaactcttacctcaggttatctgcccacctcagcctcccaagtggtgggattacaggagtgagccaaggcacccagccttttttttaattttaatttttaatttaagaaatggagtttcactctattgcccaagctggcgtgtagagctgttcacagacacactacagcctgggactcctgggctcaagggatcctcctgccccagcctcctgagtagcagtgattataggcatgtgccattgcacttggttcttgtatctgttttattaatcattttatccctggtgcttagctagagcctggtatggaataagttctcaatcagtgtttgttcagtggatgaatggattgaatggatgatttttatgttgatggtttctcttggactatggcttagttgcctcagtcactgtctttcccgtcccacagagaaccagacagatgaggtcatttcttaggacattatcctgccttgatggatccagtgccagctggaggagcccaatctgcacccagggctctgaactttttatagtgcttcttccaacttctgcccattgtagctaaaccagaacttcactattatgtctcacccatggtattcatatcagaaggcaaaggtttagctctctttggtttatggcctcttaagacttatgcagaggaaagaagcagtgtcttaactcctgtgggctcaactactgtatcttacttagataaatagattcataaatcaacattcttttagctgggtcctgttgaccagtacaaatcttttgaagcatactactcactgtctcaactgtgaatattagtgtgacattttcccccaacgcctttttttttttttcgttttccaaggaaagaaactgtatcagtagacagaagtttgcatctatgactgaaatgttttctcattttcagagtcttctgacagaagaatctggggggtgggaatgggggttgggattgcttgagtttcttgtatgtgggaagaatctatgtttgagctatactctgtttggcagtttgatggccagctgttcaattcacgtcccacagacctgacatacctagtgctgacggagtgctccagtagtttaagagttaaaaacatgtgactcatgtgcccattcaggccttctgtctcatagatcttctccttttcgataaccatattttgtgaatgatgattttctaacacaccattgcaagtttctacaacttacttagtcgttaatagatattctgactgtgttcacagttatagtagtccccttttatctgcagggaatacattccaagaaccccagtggacgcttgaaaccatggatagtactgaaccctatggatactgttttttttcctatccatacctacgataaaggtatgataaataatacactttaaggccgggcacggtggctcatgcctgtaatcctagcactttgggaggccgaggcaggcggatcatgaggtaggagtttgagaccaccctggccaacatggtgaaaccccatctctactaaaaatacaaaaaaaaaaaaaaaaaaaaaaaaaaaagccaggcatggtggctcgcacctgtaatctcagctactcgggaggctgaggcaggaggatagcttgaacctgggaggaggaggttgcagtgagccgagattgcgccactgcactccaacctaggcaacagaccaagactctgtctcagggggaaaaaaaagaaaaaaaagaatacactttaaggctaggcatggtccctgtaatcccagcactttgggaggctgaggtggatggatcacttgagctcaggaattcgagaccagcccaggcaacatggtgaaaccctgtctctgcaaaaaatacaaatattagctgggcatggtgttgagcatctgtggtcccagctactcgggaggctgaggctggagaatcgcttgaacccaggaggcagaggttgcagtgagctgagagtgcaccactgcactccaccctgtgtgacagaaggaaaccctgactcaaaaaaaaaaaaaaaaaaggctgggtgcagtggctcactcctgtaatcccagcactttgggaggccgaagcgggcagatcacctgaggtcgggagttcgagagcagcctgaccaacatggagaaaccccatctctactaaaaatacaaaattagccaggcatggcgtcgcatgcctataatcccagctacttgggagcctgaggcaggagaatcgcttgaacctgggaggcggaggatgcagtgagttgagatcgtgccattgcactccagcctaggcaacaagagcaaaactccatctcaaaaaagaaaaagagatgaggtcttgctgtattgcccaggctggagtacagtagtgattcacaatgcagtcatagcacgttgtagcctcaaactcctgggctcaagggatccttctacttaagccttctgagtaactgggactacaggcaccctgctcttggttttttgttttttctaaatggtgtcttttaaggagcagaaagttcgttttgatggtgcccaatttgtcaattttttaatgattagtgctttttccatacatttttataaggtaccggttcttaatagctttactgagatacaattcacacaccatacaattcatccatttgaagtgtacaattcagtggggtttttttttggtgtattcacagagttctgtaaccatcaccaaaacatttccatcactcccaaaagaagtcctatatatctattagccatcattccccctaaagaccaccagcagtctgctttctgtataccagatttgcctattttggacatttcatataaatggaattatatattgtggttttgtatgcctggctcttcacttagcacaatgttttcaaggtttacatattttaggctgtatgtgcttctttttattgctgaataatattccattgtatgggcataccacactttgtttattcatcagttgatggacatatggattgcttctacttttgcgctattatgaataatgccagtatgaacatttgtatacaagtttttgtgtggacatatggactcatttttcttgggtatatacttaggggtggaattgttcagccatatggtaactccatgtttagccttttgaggaactgtcacactgtttttcaaagtgtctgtaccattttacattcccaccagcagtatatgaggattccagtttatccccatcttcaccaatgcttgttattatcttttttattatggtcattctagaggttatcaagtggtatctcattgtggttttgatttgcatttccctgatggctaatgatgttagcatgttttcatgtgcttatttgccatttatatattttctttggagaaatgtctattcagatccttgcccatttttaaattgggtttaaaaaacagattttatattgaaatacaaggactgccatatggagttggtgaacaagttgagaatatgagtgtgtaattcagtaccagacatggatcagcatgctacttaaagcagcacttacttaactgtggtccttaatctaagtttacatgcaaaattctgtgacttgtttatgtgaattgtccatggctttcattacattttcaaaaagggtccatttatacttcctagaaaccaaaggcaattttaatggctgacaccaggtaaacaatagactataacattttggagcccagcctcttcagtttggtgttcccaggcgtagatccctataaggcacatgttaaacataagtatcaggctcttggttaaactttcagtgtcttaaaatgaactaattatgaattggctaatcatgctctataggagaggcaaacacacaaatatctctgtagcaaattgaaagcaaaaagacccagcacatagtggtaccctgatgactgcttgtaattaattgattcttgaatcttggcattctgttcttccctttacattttctgtagacattgtagtgaaaggtctgactagagccattaattttttaattatctatactgagataactgaaagtatgctgaagaagcttcccgaaggaataagaaaggaaagaagatgggagggaagtactgtgttggtttctaggtttgcaccattgaggagcagggttgaggcaggaggagaaagaagaatagagctaagagagtgtggtaagaaagaaatgccaagatggaatgggtggttgggagcacgtgaagatcaagagttgaagaataagaataggtcattggattttgaccttagtaactgaagagagcaatttcactagtgtgtagaggtaggcatgagactaggtgattaagaaaggaattcatcaaaagggcgtaaagttcataatacccccttttaattattttattttttatcattatttttagagacagggtcttactgtgttgcccagactggccttaaactcctgagtgcaagcgatcctcctgcctcagccttctgagtagctgggactgcaggcatacgccactgcacctggctccccttttttatttatagtaaactttattttcactgatactccatttaacgtaatttcaaagtagctctgtgccctaagatgagcaaaagaacagatatcctaaatatcataagagattttcttcacactgttcctctgagcacagcatgaggtttcagagcccccagtgttgccacttaacattttattccttgagattttacctataagatacagaaagaggccaggtgcagtggctcacgcctataatccctgcactttgggaggccgaggcgggtggatcacgaggtcaggagattgagaccatcctggccaacatggtgaaaccccatctctactaagaatacaaaaattagccaggcgtggtggcgtgcccctgtagtcccagctactcaggaggctaaggcaggagaatcacttaaacccgtgaaccggaggttgcagtgagctgagatcgcttcactgcactccagtctgggcgacagagcaaaactccgtctcaaaaaaatgatacagaaagaagatataatatcaatacacaagaatcaaactgtattagggtatctgtgggattgtaatggtaactgaatttttccctgctaagtttttttttttttttttttttttttttttttggagacaggatctggctctatcacccaggctggagtgcagtggtgcgatgtccgctcactgtgacccccgccttgcaagactcaagccatcctccctccttagccttctgagtagctgagactacaggcgcacaccaccgtgcctggctaatttttgtatttttgtagagacagggttccgccatgttgcccaggctagtctcaaactcatgatctcaagctgtccgtccgccttggcctcccaaagtgctaggattacaggcatgagccactgtgcccggccaacggtgtcttttttttttttttttttttcctaaagtaaaatgtcagatggccgggcatggtagctcacctctataatcccagcactttagtaggccaaggcaggtggatcacttgagctcaggagtttgagaccagcctggttaacatggcgaaccccgtcgctaataagaatacaaaaaaaaaaattagctgggcatggtggtgcacgcctgtaatcccagctactcaggaggttgaggcaggagaatcacttgaacctgggaaacggaggttgcagtgagccgagatccgccactgcactccagcctgggtgacagagtgagaccctgtctcaaaaaaaaataataaaaataaataaagtaaaatgtcagaatatgcaaaaatgctgtacttatttctgttaataccttgaaaatagtggaagtttgaagatttttaattcttaaagagtccaagctggaagatgactgctactgatggggtttgttcaacgtactgattccaagcttggcgaccatcagcaaactggtacctgcaattaaacctggagacataaattttccagagtggtagaatctcattcccataatgccagccaaggtctcagacgtagcaaggaaaacccaagcatcccttggatcctgagagctgataagcacccaggcctgttaaacccccagagaggaatagcattctacctgcttttgcatagtcagtgatccctccagaggcaaccagtgctgcgtagccaaaacccaaaccagtgcaaaggcactagtggaccagtatcctgcggcattgttctcttctcaccctgtcctgtgcagacagtagactatagcaggcctgcatttgcaccgctctcctgaaggtctgtactggtcaacaagatctccttatccttttaatatctataggacatttttaaatttctcttattttctttttatttttaactttttttaaagatagaaataggggaggccaaggcgggcgaattgcctgaggtcaggagtttgagaccagcctggccaacgtggtgaaaccccatctctactaaaaatacaaaaaattagctgggtgtggtggcgcatacctgtaatcccagctactcgggaggctgaggcaggataatcacttgaaccggggaggcggaggttgcagtgagctgagatcgtgccactgcactccaacctgggtgacagtgagactccatctcaaaaaaaaaaaaaaaaaagaaacaggatgtcactatgttggccaggctggtctggaactcctggccttaagcaatcctcctacctcagcctcccagagtttttctttgtttattaatcagtctttccagaaacttactaattttatttgtcttttaaaaaaaatttatttccattttctttgggttaattttacttttctaacttcatgagacagatttattttgatttttaaatttcattaattttagccatcctccttttctaatatgtttatttaaggctgtcattttcctctaaatactgctttggctgcatctcagtttttgatacatagttatttccatcgttgttcttttatttaacaaatactaagtgcctcctatgtaccagatagtgggctagatactaagagttcagagtaagcaaaacacagtactagcacttaatgagctcataatctagttgcagaaatagatatgtcaacagattattatgtaaccatataataagtgttatgtttgaggtatgtaaatacaaggggctgtcacagaacaaactctgcctgctggagtatagaaaggttccatggggtagatgggatgatattcatccatccatccactcatccatccatccatccttatagtcatttaacaagcatttgttgtgcatctattttatgtaagtcttgtgctaggtgctggaactatggctacgtcttgaaggatgtgaaaaaaataggctaatagaacaaggtgggggtgggattttaaagcagaagtatcaacctatgcaaaggcacagaggctcaggggcatggaaatgcatgatgaagctggcatgatggggagtagctagttcaccaaggctgtgtgtggtgtggaaaggtgtttagattttggggttttgggttggaaatgagaagccatggaacttaaagaaaataaacacgttttttcatttgatatgtattctggcagtagaataagtgtgaggcagagaccagttaagaggcttttggactaggctcaaagcaaggacagtaaatgtggagagatggatatagatccaagagataactaggagttggaatcagtagaatggaaggatcctggggagttaaaaaaaaaaaaaaaggcataaagtatcacttccaagtttctggcttgcgtgactggatgaatggatggtggcgccattgactagggtaacgaataccgaaagggccacaggctttggcagagaagttacaagtttggttttagatcaggctgagcttgccaaagaaagtgctatccaagagcatctggtctaaggaagcaggaataaacaaaggagcatttctggaagtggagagaggatcagtgccaccgctagccaatatggtacctttgtacaagttattaaaaaaaaaagcatctctccagggcagaccaattagaaaagggcaacctttcttcacagtagactcagccacttggcttggcagaaagcccaggatggattttagccccattcacacccttggctgggtacctatgtatagtgcacagattatacaaccatacacaggagccttgggacttacttgggtttagggatatgcctaagagctcagcccattgttcaacaatagaaaaaggaggcaggaaactgaatttggctgggggtgttggtcagggaaggaatctagtaattgctgaaggatttggtggtcaggcctctttccagtggattacattgaatcttgtcctcacccgtgaaaggggttactatgagccctccctatcatctaagggcattatgaggactcaaggagaccatgtatatgaagtctttccggcatctctgtacccccaatttctagtaccagacatggcacacaggtttaaccattaaatggtaaaaggaatggtgaaggtcaaatgaagaggtgcatagtggtaaactgaagaatgtatacttggtaagtgttgtgactagtgagcaaatatgaagatagtacaggcccagggagggacatcttcaggggaccagtggtaagagataatggcagataaagagggtgttggtcagaggtgtctgctgtggcatgggggtctcagagcttggtctctggagtatgggtaaagggaagcaagctgagaattgaagcaccaaagagcagcagaggcgcctgagacaagaaatctggcaggtagtcagccccttagctgatgttacggtttgggaagagtgaggcaaaaagaagaaagtcatccagggaggaagaaatggctgttgggaagggttctgtcatagtagaagagatttgggaaaagtgaagaggtcttatgcatgatgatgtggaatcccagtggcaagaagcagcaggatgatggcatcctgaagtctactctctcttctctttgccctactcagtaagaatggaggaagactgagtgggagaactggagggtttcttgagggaacatagtaggtgatatgttatactcaggacaaaggatagccggaagagatgagctctagattggtttccgcgtaggtccttgagagtttgatagcttgcttgatccattgatgaacaaaatatctgttgtggcccaactggatcaggcagttgagatctcaaggtttggtacagtgtctgaggaatttaggcagctgcaagacaggtgcttctaggccgagtgcggtggttcatgcctgtaatcccagcactttgggaggccaaggcaggcggatcacctgaggtcaggagttactggccaacatggtgaaaccccgtctctactaaagatttaaaaaatagccatgtgtagtggtgggcacctgtaatctctactcggaggctgaggtaggagaatcgcttgaacctgggaggcagaagctgcattgaactgagattgcaccactgcactgcagcctgggcgacagagtgagactctgtctcaaaacagacaaacaaaaacaaaaaacaggtgcctctagccacttaggtcccaactaaagcaaaaagggaaaaagcatcttcctgagagacagaccactccaagcctgaattatccagggtagtagccaagagaagcagagctagaatccagtcctacagccttagtgaagacccaggaagcactggtaacagaagtccagcactctgtatttcataaggatcttttatacatagatctgacttaatcatcatagtgatcctgtatggtgggtatctgcatttcacagatgacaaaatagaggtgtagaagtttctagaagaagctggagctatttacctaagggatatgaattgattcttgtgagttgttacgtctttagttgtctgtagccttcgactggaggcagctcatgctaatctggtcagcctacatgtaactggatattctagcctttaaagggtgtttgtcctctgttagaggctaggactccacctcaggttagattgaaggtgctgcaggagtattcatctccctccccaggaccctgagacttggaggcatggacaggacctgggctgtaggtcctgaccatagtgtatgtgtgttagtgtatgtgtgtgtgcacataggctgtgtgtgtgcacataggctgtgtgtgtctgggagggctgtggaatcagtatatccactctgggggtacccatcaagcacacatatacacatttgtgtaagtctctgtaagtgttcaggggaagaaggatcaaaaaagtgtttctttttttttttttttgagacaggggctccctctgtcacccagactggagtgcagtggcatgttctcggctcactgcagcctccgcctcctggattcaagcaattcttctgcctcagcctcccaagtagctgggactacaggcgtgtgccaccacgcctggataatttttggttttttgtttgttttttgagacagagtcttgccctgttgcccaggctggaatgcagtggtgcgatcttggctcactgcaacttctgcctcccaggttcaagcaattctcctgcctcagcctcccgagtagctgggattacaggcatgtaccaccacgcccaactaatttttgtatttttagtggagacggggtttcaccatgttggccaggctggtctcgaactcctgacctcaagtgattcacctgcctcggcctcccaaagtgctgggattacaggcgtgagctaccatgcccagccgtgtttcttgtttctcccaacccttccacttcttcctattttcatgttttctctctcatttctctttttcctctcctttccttgtgagtttagatggcattgtgattaagttctctggcacaggacttgtcactcagctttgtcatgtcagaggacagggtccctctgtggctgagactttgtaacttcagtcagttgctgaataatccagagtacttctgctgacagtggcctgagcgggtgggggggaagtgacgggcagaatttggtgtagccacacctgagactgagcctcccctcagccccgtgtctggcaccatcatggtgggtgggaccagagggtacatgtgaacacagacaaagatttgttttgggggtgaaggtagagcttggtcaggggaagccgaagaaagtcatatatcaggaacagcccaggagttagcctgtctgtcccctttccacagcaacaggtgagaagaaggaatgctggtcgtgggagtcctacctagaggagcagaaggccattactgctccagtcagcctcttccaggacgtgagttggacaatttccccgtaggaacagcttgtcttcctagcctagggacacaccaccaacctcaggccttctggcgttttctgtgtcaggcatgcctcagtggactggcagaatggaaagggagagactgtttaggggcccagagtggaaaagggccccccataaggggctggcagggtgggaagaaacagagaggtggaagctaggctcactcatcactgggcctgcagacttttgaattctggtgacttctactcaattcagcattgatctttccatgactttggtgagagggagcccttgagtccagccctgactcacccacatttttcaagggacctgggagatattctctctctctctctctagatccctgtagtaacgatccccaaataagttgcccctttggaaataccaggcgggtggggcctaaaggcagctccttcaccccaagcccactaggcaaggataaggctggatggaagctgggtcctctccactctgtgcgttgacagtcccaggcagtcactcacaacaagaatggcttcaaactgggcatgaagttggaaggcattgaccctcaacacccgtccatgtacttcatcctcaccgtggctgaggtgagctggggcttggtaccacctttctgatgatgtctctcagtgcagattgatggatcttgctggggacatagaaggaaacacctccctcccctcagagcacacacaatctagtagtggatgaagctggaatacatagaaagcttaaaacaacaaaaaccagatggagttcatgggacagtcctattattggatgaatgtatactgtccactctgggggagcttgaggagatcccgagggccagggatgttggcatgagtcaaacaaggtccttgtcctctaggagctcacagttgtctggggaatcagccaaataaacatgtcagtgacatgccacaggggtggcagcagacttgagctgggaggcacagttgggtcagttctgtctgaggagcagcaaaagcatagaggaagggcctcctttgcagagtcttgagagataagttgtgaataaggagggagctccaggcagaaggagcaaagtgggcaaaagccctggggcatggaacagactgctaccttcaaggaattgccactagctcagcaagactggaagcagagtgcgagtggggagcagtgagagaaggtagcagagggagcggtcatcaggagccctcagcagtcctgagccttggtggctgccctcagaattctgtccagggctcaaaagggcaggaagctgtcatagggtccacctcccttgcatccagaactcagggctcatgagtacatgaactgtcctcactgtagaataggacagggtggggtacaattgggaggaaagaaaggtggggttggggaacctgctagcattagagcccctgagaccaccagactgggccaggagaggtgaggcagatggggagtggggcatctcctgacattggagttcctgattcccctcatggggccaggtatgtggctatcgcctacgcctgcactttgatgggtattctgagtgccatgacttctgggtcaatgccaactcccctgacattcaccctgctggctggttcgagaagacgggccacaagctgcagcctcccaaaggtaaggcctagctgggttggtcacagtgaggcagtgagtcctcagacccttcgcttcttccccttgggtccccggcttccagctcttttgttttctgaccctgtaccctgttccaaagccagcctctcttcatcgcatcctgatgactctgcgctggggccaagttgaccagaagccctagaacttccgctttgcacttgccctttgagtgtctactcaagtcgtgtcctgcttcagtagtggggaatccctgggcaagttcttgagggttggggggaggtcctcaggcatgcctgattctgctgcttcactgtggggtgcccttgctgtggcccagcctctgcacggcgctctgttcatgcccctcgaggggcctaggttacaaggaggaggagttcagctggagccagtacctgcgcagcacaagagctcaggctgcccccaagcacctgtttgtgagccagagccacgtgagtgcccctgagtgagagtggatgtcactcccatgtgccagagttcactgcagctggcccagggtatctgactcatcagaagggagctcatgtgctggttctctcagctttgttctgatctctcatatcagatgggaggggtacagctgggcagggtccagggccagagatgggaagctggttataggtttttcccgacttccctccctcctttgctactgcagataccctgtcctcacatccccttggagcccctggcccactaccctagtctgagcactgagatgtcattgctcatatattcttgctttggcttgctctgcagttctttggtgtaaggtcaatgcctctattctgggagcttctttttctttccttttgcccaacattgagactcttccatttatttccaacaattcatcccttgtcctttcctctgttcagggcagctggcagcttatccagcagttaaagtatctcataatcccaaccaaaaggcctaagagatacagggagcctccattaaaaatatcatactggaccaggtgtggcggctcatgcctgtaatcccagcactttgggaggctgaggcgggtggatcacctgaggtcaggagttcaagactagcctgggcaacatggtgaaacccccatctctactaaaaatataaaaaattagctgggcgtggtggtgggtgtctgtaatcccagttactcaggatgctgaggcaggagaatcgcttgaacctggggggcggaagttgcagtgagccaagatcacgccattgcactccggtctcagcaacaagaacgaaactccgtctcaaaaaaaagaagtatgtatcagtcttactggctgggtgcggtggctcacacctgtaattccagtactttgggaggctgaggcgggaggatcacttgagcccaggagtttgagaccagcgtaggcaacatagtgagaccccatctgtacaaaaaatgtcattaaattattagctgggcatggtgcatgtgcctgtagtcctagataccacagtagctagctgagctgggaggattgtttgagcccaggaattcaaggctacagcaagctatgattgtaccactgtaccccagcctgggcgacagagtgagaccctgtgtctaaagaaaaaaaaccatattgaatgtctagagtttccctgggcccaggactccaccatgctcttcaggcagagacagttactcccctaccccagtccagccccagagttcatacttgcaagttcccaggtgacaggtggggtcctgcctgctgttgtgacaacgaatgccgacttttaattcaaactatttaaatactggccccgccgttgactagcattgtgttctgggccaagtgatttaacttcttaaatgggaatagggttgttgtaaaggtccaaggaggtgatgtcttttgaagcttacatggcaggtactcagtttatactggttccctgtctgcctctatgccatagatgtccgctgtttcttcccagccaccccactgttgccacaactgcctcaggacaagctgggaagggcttgtctgggtagggaagatttatacttggttcaccaggttctttgggcgaacgcatagcctccttccaggcacttaccttctgacacaagccaggcctctgagtgcaccttggaggccagaggttcctgagtgcctcagggctcaggttatgattctgccctggagggccctctttcccagcttatttctccttcctttctcactgcccacaccccaggctttcctagagaacctattcctttgtttgccaatgggctctgggctggtcttagccagcttggccctggccgtggcagctcctttttttcccctagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtagtaggagggcccagacttggcctcagggggtgaggggatggcagggggcaactgctttcatatctcaggtaccatgtggcaccactcagtccagttctgacattcagatcttcctccggttggaagataattgaattgagctttatcataagaaatacagctcaatattaaatgtttcatctaaaaataccatggttaagatgagcaagcccctatgattcatgattttcccttagatattatggtgatggtagagtttgtaattcatgttgcaattttctaactttgtccttgccatctgtctccctctcactaagaagtagatgagggtgggccctgagccatgctttcagaggatggcaggctcagggcctcaagtttctcttgggacagtgacatgttcttggatttcaggtgtgatcccagcagcccctacatccacccagtgggctggtgccagaagcaaggaaagcccctcacccctccacaaggtgaccctgcagcctgagcaagccccctttcctaagcctggctctgcttccctctccactgacccctcaccagtagtgccccagtagctggctctctagggtcagggtgagagaacagacatgtcctgaagcctcagcttcttggcctgggagttgagaaccctttgattttaggagactcctgtcaaaccctgactccactggggtttaggggaagaaagttacatgaccatctcagcaaggaaacagggaatcagaagtaaagaaaatgagtccttcatcctgggagtattgcattggcccaaatacagtagagattcaaatggggctggggtgggagcaacaggccaagagtgacaggagtcagggttcccagacagccctgtgaactattagggtggtgccttgcttggttctactagcacccatctgcctgaggagcccagtgcaaggagctggctgtggtgatggtgggagagattctactccaagggcttctgtcccttccatgttcctggtcctgcttgggggcagagggcttccgcagtacacctgggtggctagacattgctctcatcctctcctccagactacccagaccctgataacttctgttgggagaaatatctggaagaaactggggcctctgctgtccccacctgggccttcaaggtggtgagtcagtgctccctgaccccagagctgagctcagaaagacatggagcactcagctagccaggctggggccctagccttcccctttgggcaggccccagtttccccaggcacagcatttgggctccctctgtggggctcagctctgctgagctgcgccttgccctgaaggcagctgtcccctctgcagcgaccccctcacagcttcctggtcaatatgaagctggaggctgtggaccgcaggaacccagccctgattcgcgtggccagcgtggaggatgtggaggaccatcggataaaggtggctctgggaccctagggctgggaagtggacaggccagttgggcaggaattctgtagactgtttagaggtcaggggcatcatggcatgagagagatgaagccaaagatcttgaatctcattcttgcctcatctgtgacttatttttgtgggcttggacaagtcattttccctctctaagccttacatcatctgtaaaatgggcctaataatcctcgtcccacctaaggattgccagtgggagatgccagtaacttaatgagtgatgcccttggaaaatgtggtggccaagacagattattgcagggttggccccttggttctttcaatccaggatcttgcttctgacaggtcccagggatggggagaggaccttctggctgagctgggctccatgagaaacgcctgacttccaagagcctttcctccccagatccactttgatggctggagtcatggctatgatttctggatcgacgctgaccacccagacatccaccctgccggctggtgctccaagacaggacatcccctgcagcctcctctcggtgtgtacccctagggcactctgatcttttcctttccccccaggttctgacaatcctatagtttgcctacagagctctgactccccatgcccaaatatgacacagagggctctgatgcctaccatgagttccagaatcccccatctgccccacccccggaccatctgctacactaagcagtgcttctggctaccccagttgtcggggtttggggtgttgaggtgcaaaggggcaagctcacttggttgcatgtgcttcagaggtggtcaggcacccagggatttctctcagcatctagcagagccacactgagcgtgcactgtttgctaaggacatgatggcttcctaaagtaaattctgattgtctgtgcaggcaggggttagagttcaggtcactgggctgctcagccccattttcacccttaggatttcccttccttatttccctgctgcaaccgtgtttgtctcacatggggtgttgatccttcttgaatgttctccaagcataggcagagccttaaaaaagttaccaaagtcttggggatgaaaacaagaaaaagaactgagagtgacatgaatctgccagatgtggcttctaaggtatggctacacccaaccagctctgagtggctcttctcccccagagttctctcagagactgagggcatagcctgcaggtttcagcaaagtattaacatatgagagctaagccctccttacccagagaggggcagatatccagtaacacagaatggtgtcacagccaacgcagggccctcatccttggggagtgggtttctagtgctgatctccccagtggaaactgctccttccgtgccccacactccccacccccaggactccatgaggaccgcctcctttctgctcttttaggacccagagagcccagctctgcctcccctgggggctgtccccctctcagctataggagcctgccccacactaggacctccaaatacagctttcaccaccggtgagtgaaggttcctggtgagagaccctcagcgttgttttgcacttactgcatgcaggcgactggggtccaccaaaacacactccagctgggaccagggctgaggagggctcagcggggaccagtggattaaacccaactgaagtctcttcttccccaggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccggtatggaggccagggaatcagggcccgggcttcctgggggtgtggggccttgtagcctcttggactgggccagacactgattccctgccatggacctggtccgtctttctccagaattggacgccctccgaagtatcgaaagattccgcaggaagatttccagagtaagtctgggttatctgctcctatgtcctccaccacagagtgttcacagcgagtgctctgtcattggtgggatgagacagatttcccagagtgggagaagctagaaggagggctgtgcctcttcgtttgagatactgagagcacagagcagtggcaaaagcagtggaggggccttgagtgaccttgggttccaatctcatgtcccccatggccttgctgtgagtctgtggggagggtacagagcttctcggggcctttggttctcactgtgcagcaagatgatgctcctgctcttctctgattctaggcttcctgggaaggaggccatggccatcactttctacctgtgtgatcttaagcaagtcacttaacatctttgagcttcagttttctcacttgagtaactggataaaacctgcctttccattgtcaatacctgaaataacagtggttactaccactgcttactgagcatctactatgggccaggcactatgccaggttctttacacatactgtgtctaactctcacaagagttctctaacatgtatattgttcttctgtgagaggaggaatgtgagtctcagagggtgatgtcacttgcccaaggtcattcaccttgtaagggggagagctggcattccaactcggatctggcctgactcctcctgctgcatgctgctggtataagagacataaagcacctaacccaaatgtcagttcacttctcactccccttgcactagcgtgcttgctgctgtaacaaaaataccatagactgggtggcttacacaatagaaatttattttccacagttctggaggccagaagtccaagatcaaggtgttggcaggcttgatttcttctgaagcttccctccttggcttgcagatggctgccttcttgctgtgttctcacatggtctttcttctgtgcacaagcattcctggggtcccatgatgtgtccaaagtgtctcttcttgtaaggataccaattgaattggattagggcccatcctaatgacttcattttaacttaatcactctttaaaggccctttttccaaatgcagtcccattcagaggcactgggggttagggcttcagcatatgaattttgcggggacacattttagcccataacatacttcagcgggaggggcatagtggctgagccctcccctaggtggtgaattcatcttacatcttcagccactagtacagggcctgatgcacagcagggacgcctcagttgaatggaatgcatgtcattttaaggctaaaagagaccttgagaaatcacctggtttagtgcaccttggcgagacccaagctgtcccaattcttcaagaacagtctctgtaacctgggcagtaagtaacatagtgataaaaagcatagccctgaagtcagactaccttttacaggctgagagatcttgggtgggtgacactcctctctgagcctcaccttccttatctgtaaaatgctgataataatcgtacccaccgtatgatgtggtgagaggcttaactgagatgttccatgtgaggtgcttagcacagctccctgccagtattattagtctgagtctcttgcctcacttcctcttgctgtcatctcatactgtttcctctttgtgggaacagaagcagtttcttcagcctcagacctgagtgatgagggtcttggccagcacctagaccctcagagtaaggactcctaaggatcaaactgcagtgggcacctcttgtacccatctgtggtacccatggtcaagtccactgcaggaccaagttctgaccaccagagggcacttgcctactgtgttcatcccagaattaggctgtagaattcttgggaagctacatctttccagaggctgagactatgtcacggaactggcaaagaagggctcacccagatccttgaggcacttcaaggatagagcaggggtcattgcccaggtctcacttccacagggcacccctgctcttctagctggcctgtcacccagaagagccactggtcactctgggttttgttccagaggcaacttcttacatactggtgggtagacctccttagtgtaggctctgaggtttgctggtgaacaattccataggaagatctgcccggagaggacagggcttggctgggcttagtctttaggcctaggagtgtcagctactgaaggaactgaggagccatgtctgacctgcaactggatggtctgcagttagataagacactgtaactgctggtaagcactcctggcctgtgctcttccctgtgctctggggaagaaagataaggagaaaagctccctacaaacttgatgttgtctcccaaaccccaccccagggtatgaaacccagatacagggtttcagagagggagtacctgggtgtaccagaggccaaacctgtggccaggtagatgaggtgctagtggtgctagctgtcatgagagatgctgagtgtgccccagacgggccatgagaggagctggctgagcagggagatggggctgtctggggtatgggcaggtattaggatttcgctgatgaacagagagagcagcaggaaggcagtggcacagaagtgtggttggtagggctgaggatggaatcccagaggctttgtgggtgaatggaggtggaaaagccaggctgaaaggctgacactcagggagagagggcaggacaatctgtgaccaacagggagggtctttgacaagagggcacttggaggtgctgcattgatgagcatctggaattagcaccaggagaataaagagccaatgctcctggaccatggacagaggctgggaaaaccccttgggaaagtggccacattgcacaaggccggccaaggctgacagcagtgagtggggccaggtttgtcaaagcagccagagggggatgaagtccaagttggcacgtgccaggccccaccaagggggaggccaagctgagcagcatcggtcatcagctcagtacagctgcttgaggtaggaggttggggccagtgatcccagaggcagaccaggaagcaaagccacaggcaacatggagctggggagtgggtcagggatcaccctctagtgctggcataggcagtagtacagaccgggctggtggaggaaggggaggaactggagcttgaggcaatggcagtggccagaggggtggtcttcagcctggtcagggggactgtgattctgaagcagaatcaccctggctctgagaaagttggtcgtggcccggaaggactcatgagaagaagagtaaacagagtggacttctgacatcaaggctgagcttgtttggatgttaaggacccttttgatggttggcatctagaaaattatgtctttagagatgctgcagcagctccaagagagtatccttgcagggcccagggtggtgcagcctcagagagacggggtgagggtcattccgaatagctgacctgagagtctttaagagagtcactttaccagcaggagtgaacactgtgtgaggagtcaggagatacggctcaccctcttgactctacaggctgtcagaaggggcccggagtcctgtctactctgccagccagtctcctgagtggtgtgggtatgcatgggcttcgggaacagtttagtcatcctcgttggcctgccagcctctgcctctgctttccagccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtgaggagcgagggcccttctttatccttctcttcctctcctcctccctctcaccataccctggtggaaaggcccaggtcaggtagaacccggtaccactcctggcactacctcttgctcatctgtcctgtgcacagtcccttctagctgcccagtaggggctgactgagacccttcctgataggtccattatggcagagggggcgggggctgtgctgctgtttcagccagaaatccagcaggagaggcaggcttcggtcccaggcctcagaagcaaggggcccaacttggcacatctgccagcatagaaaccctaggatccttttaggctggtgagaaaaagcagcattggcacagctcagaagcacctaggctgtggaggccagctctccctacatgcctaagctctgtcccctggtcaacatgtcatctttggtttccaaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgacttttagtgcatagttgtccttaagtaaagaactttgtcggccgggcacagtggctcacgcctgtaatctcaggacttcgggaggccacggtgggtggatcacctgaggtcaggagttcaagaccagcctggccaacatggtgaaaccctgtctctactaaaattacaaaattaactgggtgtggtggcatgcacctgtagtcccagctactcgggaggctgaggcaggagaatcacttgaacttggaaggaggaggttgcagtgagccgggattgcaccactgcactccggtctgggcaacagaacgaaactctgtctcaaaaaacataaaaagaaagtagttggctcttcttgccctggaagagtgtctgtatccaagcccagcacagccagtttcctcctttgagctgtgtgtggtggagctcccaaactcctcccacttccaggtgctttccttgccctctgtgttggtgatcttctcttcatgtacgtgtccagagctgaactccctgttttcgatggcctctggccaacatagaacacaccggggtgctgctcccctagaagtgttttaattgagataaaatgcctatagagagataggcacacatcttgaaagtacaatttcacaggttttatgacatgtctgcccttgaactcaacatttcaatcaaggtacagacatttcctctcgtgttaagtcatacaaaaaaaatttaacaaaaaaaaaaaaaaaaaaagaaaagaaaaagatacagacatttccctcataccagaaagttctttctcagccccttttagtcagtccgcaccccaaaagacaaccacttttctaatttctagcgtcatagatgagctttgcctgttctggaactcatataaatggaatcatagagcatgtactcttctaggtctgtctctgcacagtgtcatgtttttgaggcttctccacgttgttatctgtatctgtagtttgtttattgctgactggtgttccatttcatgagtataccataatttcttgttaatggtcaacattagggttattttctcttcccctagatttgaaccctatttttttgttagcaaaacttaagtttgccctagctttattatagccacatcacactagtttggggttcataaaagcccccaggtggttttcatgtcaactacagtcgaaccaaattttccagtgagtacttgcaccactgagtttttttttttttaataacctcatgtaaaactttacatccaccctattaaatgttatctggttggtttcatagccttgttttaaatcttgattctgtcatctacgatgttaataaggctttccaacctcatacagcttgcacatttgataactaagccttctgtgtctttgtccaagtcttaacatgttttatgagaaggcagaaccacgtggcacgctgtttcaaacctttctgtcggttgaccacaggtcttcgaatgtagttgttcagccagctgcagagccacccaagtttcatcctccagcctatgcttggctttacattctcttcttcttgtgacaagggctgtgtctcccaggaacatttgctgtgtctcttggttcagcatggtctgtgatataaaaaactagtggccaaagggaggtgtactggtagactgccagcattaaatagaatctcagagtggagcaggacctttatggggtctgaggatcaccatctccagtgtctggcccatgtcatcagtttccccatgtaggacaatgctccaggagtgggctctctctggcttaactgatgattgggtattcagggacaccagtcaagatgctctccatctgggacacagaccagccagtagagggttgcttcatgagtgaggaattagagcaaagtgcatagatggtcttatggttgttctgtactggtggccctaaaagtagtctgtccagtcctctctttgtcatctttattgtagccattgtgtatttgtctaattcatcagcaaataattattgatgtctgctttgtgcctggccttgtataaggtgatgtgatactgaagcaggtaagaacaggtccctgctcttaaggttctctgcatggtaggggagacagaattgtaagttgttgctcctggtggagtgtggtaagggccgtgaaagacacatgtgcaggtgtcctgggagcccagaggaaggggaggacagagaggggccagtgggctctactaactgtgcagccagatgtttactggcagcttcctgcttcccaaatgtctgattttcttgggctcctggtagaccacacctttctgctgtgaaagcatagaagtcccagtggggttttgaaagtgccaattaaatcttagcttgacctgtgttaaacattccatgtgtggctctctcaagatctatccagatcacctcaattttaggaaattccctggacctctccacagcactgcaggctgttgcttagggtggattattgtatggcttattttatccattttcctgttgatttcctctaccttcaaggtcagaacatgacccttttcctgatcatatgactcaaaactccccatacccaccagcacacagacaacatcttagattttctgaggtcattccattgttcccttacctagtctcagactgccagaccacagactctggcctttgctttgaagaacctggaacctgggctttggcagttaccgtgggtgagaaatctcaggcgatatacaaggaaccatataccagtgggttctctgaatgataagaactgaaatcctgaccggggcggtggttcactcctgtaatcccagcaatttgggaggccaaggcgggcggattatttgaggtcaggagttcgagaccagcctggccaatgtggtgaaacccagtctctatgaaaaattaaaaaaaattagccaagcatggtggtgcatgcctgtagtccagctactcgggaggctgtggcatgagaatcgcttgaacctgggaggtagaggttgcagcgagctgagatcgtgccactgcactccagcctgggcacagagcaagactctgtatcaaacaaacaacaacaacaaaagaaaataaatgaactcctgtaagaatccatgcttaactctgccaggggtttctttccttcatatcctgaacttcgagatctccctggccaggctttgtgattcaatgggaccatcaagaaggagccccagaggccaggcatggtggcgcacatccgtaatcccagatgtcaggagttcaagagcagcctggccaacatggtgaaaccctgtctatacgaaaaatacaaaattagccgggtgtggtggcacatgcctctggtcccagctactcaggaggctgaggcagaagagtcacttgaacccaggaggtgaaggttgcagtgagctgagatcatgccaccgtactccagcctaggtgacagagcaagactcagtcttaaaaaaaaaaaaaaaaggtggggagctccagagccagaccggcatgaggtgtctgaatctggatgtttctgcacagacacatctgctgggggtcagcaaagagagctcctcaggtccaagggagctgcctcctgggatgaccacttggcatccccctcacagctcccagtgtctcaggcaagcagtatctccagtgcttccccatcgaggaggtgctggagagagaatagagtggcagactccttgagaaagggggaaatgggcttattcagcagaccctggtcttagacctgagaagccgcttttcacttgaggggtcattttagagcattagaaaggaagcttaatgcaggtaatctcatcggtgtgtttggctactagactttcattttcttttgggggaaaggtttttagccatcagaagtgccagttttcagagcctccttggttagtgaattgggaaagatcaggtaactgttttctcagagctgctggggggacagatatatggggttcattcccccactctgtcctgcctccgtttaacctctaaggttgccagcctctctgagatacagtcctgttgtcgccacacctcagagatcctttcattcattctttctggatttactgagcacctgacttatgtcaggtaagcagccccctggtggtcctggaaggcaaatgaagaaatacatacaattcaggggagtttgtggaactgtgtgaactccagacagagtggaaggagtgggcagttctgactgctggggaagcatgctgacagtgggcaggccttcctggcaggggtggtagagggaacagagctgcaaggcagaagacacccagttattggggaagggtctgtagtgcagtctgtggagctaggtgtgaggagggctcacttggaactgtggggcagggccaggcttgggcagcattgccccctgagctgcatgagtcatgtccataggatacccctacccagctctcacagtggttaggaacacaggtcagcacttataagctaggtatatcttgggcaaattctgtagcctgtctgccttggtttcctcatctgtataatcgagataatgctggtattgcttcatagggttattgtgaggattaactgagttaatacacaacaggtgcttaggagcagtgcctggcacgtaagaaacaacatagaagtgttttcattgctatgatgcttgaggggtgagcataggagggatggcgtctcctcaaaaacagcgtcccccagctcagtctcttgacccccacagcctgcctcccagctctcttcattctatcctgtcctccacaactgaccaactgacttccctccttgactctacccatatacctagctactagaattaacaattactaatattttccatatttgtttcacctatatttggatgaagtaattttaagtaaattttagacatcatgacatttcacccctgaggacataacttgcatctctaaaaactaaggactttcttttcataaccacaatattgttatcccactaccaaattgcaagtaactcctttatatcatccaatacccagtctgcattcatatttcccagttctcaggatacattttgcagtttttgagccagaatctgaacaaggcctacataattggttttggtttttatgtctcttaagtttcttctattctagaagagcccctcccatcctttttttccttttttaatgacttttttttttttttttttttgagacggagtctcgctctgtcgcccaggctggagtgcagtggcgcgatctcggctcactgcaagctccgcctcccgggttcacgccattctcctgcctcagcctcccgagtagctgggactgcaggcgcccgccaccacgcccagctaattttttgtatttttagtagaagcggggtttcactgtgttagccaggatggtctcgatctcctgacctcatgatccgcccgcctctgcctcccaaagtgctgggattacaggcgtgagccaccgcgcccggccaattgacatttttaaaagtctttcagagtgtggttttttggatttgtcttgttgctttctagtggtgtcacttaacttgttcctctatcccctgtatttcccatgaactgaaagttagatccaaaggctgggttagacttaggttaaatttctcactgtcactgtctctgtttctctctctgtgtctctctgtctccccctgcccccctctgcttttggcaagactagttcctaggtgatactatgtactttgtactgcctcatgttggaatgcacacagtgtctgcttgtcttgctgttagcagcactaaggttgaccaatgaggtcatgtggggacaacaagagcaggtttctcaaagccagtgtctgtgaggactcaaaagacattttgcggatacaaatgctaaacctcagaccagtcagcagaaagagagaaagagaacaagtgtgtgaacacggggaaaccagtggctgtctttctttccttctccgtccccattgctgtcttccttttttcctttctccctcccttctcctttctcccggtcctttctctccccttctctcctccttccctttctcccgcatatcctttactcctactcccctcccccattccccatgcacacccctccctttccttcacccctgccccgtgaccctttccaccttctccactttccacctccctcccgcaacccctcagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcgtgactggcaggggcattactcatggagtcagttggactgtggcagcccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactgatacgcagccagagtctgtttctattttcatgataaaacatccagagaacacaaaatggttatcagtagtggcactactgaagagactaaagtgttctctttgttgttagttaggggtccttatagtttttaaggaaagaaacaaaggataaggataaatgggtatctgtctgcactgaaagtgtaaacagtgggaactcccagagatcggtgtgtaaaagggcctgatccttaacatttgataaatggtcaagggcagaaaattcaatgaaacctgtaatttttaaaataataatatcagctgggcacagtggctcacacctgtaatcctagccactttggagggccaaggagggaggatcacatgaggccaggagttcaagaccatcctgggtaacgtagctagatcctgtctctataaaaaaaaaaaaaaaaaagtattttttatggtggcatatgcctgtagtcccggttacttaggaggctgaggcgggaggatcacctgagcccaggagttcgaggctgcagtgagctgtgattgcaacactgtgctctatcccagtgctcaaataaaaaatgaaaacatcaaactttcagatggggaaatgtcaacctgaacagttagattttgttaagcttcccagagactacaagcaggtgggaaggtggcacctttcccaccttaaagtgtttgatcactttaactgctttctcgtcaatatccttaatttctttgccctgctgctgttccagatcacttgtctagaagctccaaccatggagctgtccgagagcgcatcctctccacaccacaactgggaacctacctgaccgagattggtgccatgatagactggtagaccctggcttcaatgtgaactgaaccctcagggctacccaggaagcacgtagggtctgggggctttagctctgacttcccttttcatgcttctcaaacctcctaccccattgtcttgacagatatccttaccatccatgtcacagagaaagtggaagtcataggaagaaacaccttcaccttcctgccgtctcatctgcatgtctcctcccacccccattcattctgtttctttcctattacagtggaagacttgatgcttccaacttgtcagaagctaatcttctactagccatagctgcaataaaaggaaaagaaacattaagagacaggaagaggcttttggacatttaaaatgggattatggagataaaaattcaacacaagggtcaaaagataaagttgaggacatttcccagtaggcagaataaaaagaaaaagagaggccgggcctggtggctcatgcctgtaatcccagcactttgggaggccaaggcaggcagatcacgaggtcaggagtctgagaccagactgaccaacgtggtgaaaccccgtctctaccaaaaatacaaaaattagccagacatggtggtgcgctcctgtaatcccagctactcaggaggctgaggcaggagaattgcttgaacccgggaggcagaggttgcagtgagccgagattgcaccactgtactccagcctgggtggcagagtgagacttcacatcaaaaaaaaaaaaaaaaaagaaaagaaaaaaaaagaaaagatgagaaatgggaaagaagaaaatatcagaggactagttggaggcccaaatatatgattaatagaaattctaataagagagaaccgagaaaacaaattatatcaaaaacaaacaacaaacttgtatactgaaaacaataaaacattgctgaaagaaattcaagaacacctaactaaatggaaagagatctgtgttcatggctaggaagacttaatattgttaagatgtcaatattacccaaagatatttacatattcaatgcaatccctatcaaaatctcagctgattatttttttcttgcagaaatggaaagacagatccttaaattcctatggaattgcatgaggcctcagatagcccaaacaatcttaataaagtataacaaagttgaagaacaaaccgatttctttctttctttcttttctttttctttttcttttttttttttacagagttttgctctcgttgcccaggctggaatgcaaagccacaataatcaaaacagtgtgttactggcataaggacaaatagaccaataggatggaattcagagtctaaaaacaagtccatatgtccataaccaattgaaatttttttttttttttttttgagacagagtctcgccctgttgcccaggctggagtgcagtggcgcgatcttggctcactgcaagctccgcctcccgggttcacgccattctcctgcctcagcctcttgagtagctgggactacaggtgcccgccaccatgcccggctaattttttgtatttttaatagaggcgaggtttcaccgtgttagccaggatggtctcgatctcctgacctcgtgacccacccgccttggcctcccaaagtgctgggattacaggcgtgagccaccacgcccggcctaaccaattgattttcagtaagaatgccaagtccattaaatggggaaagtacagtttcttcaacaaatgggtctggggtaactggatttatacttgtaaaagaatgaaattggatacctacctcaccccatattcaagaattaactcaaaatggattgatgacctaaatataagaactaaaactataaaaccctaagaagaaaacataaaggtatatcttcatgaccttggaattggcaatgaattcttagctatggcaccaaaagcataagcaacaaaagagaaaatagataaattgaacttcatggctgggcacggtggctcatgcttgtaatcccagcactttgggaggccgaggtgggcagatcataagtcaagagatcgagaccatcctggccaacattgtgaaaccccgtctgtactaaaaatacagaaattagctgggcgtggtggcacacgcctgtagtcccagctactcgggaggctgaggcaggagaatcgcttgaacccgggaggcggaggttgcagtgagccgagatctcgccactgcattccagcctgggcagcggtgcaagactctgtctcaaaaaaaaaaaaaattgaatttcataaaaatttaaagacttttgtgcatcaaaggacattatcaaaaaagtgaaaagcacctacaggatggaagaaaacatttgcaaattttacaagggtttaacatgtggaatatataaagaactcctaaaactaagcaacaaaaagcccagttaaaagatgggcaaacaacttaaatagatatttctccaaaaaaatacatacaaatggccagtgagcccatgaagagttgctcaacatcattagacattagggaaatgcaaattaaagccacaatgagatatcactttctacccattatgatggttataatttttttaaaaaggaaagtaaaacggtgaggctgtggagaaattggaacccctgtacattgctagtggagacataaaatggtgcagctgctatggaagagagtttggcattcaaagcgtgatgtaggctgaaaaaaagagtttggcagttccttcaaaagctaagcatagaactatcacatgattcagcaattccactcctggtatatacccaaaagatttgaaaacatacttgaatgcctatgctcattgcagcattattcacagcagccgaaagatgcaaacaacccatgtcatcatcaacagaaaacaaaatgtggtctatccattcagtggaatcttaattcagtcaaaaaagaataaagttctgatacttgctacaactggatgaaccttgaaaacatgctaagtgaaataaatgaggccgggcgcggtggctcatgcctgtaatcccagcactttgggaggccgaggtgggcggatcatgaggtcaggagtttgagaccagcctggccaacatagtgaaaccctgtctctactaaaaatacaaaaaattagttgggagtggtggcaggcgcctgtaatcccagctacttaggaggctgaggcaggaaaatcacttgaacccgggagggggagggtgcagtgagccgagatcgcaccactgcactccagcctaagcgacagtgcaagactccgtctcaaaaaaatgaaaaacagacacgaaagaacaaatattccacacatatgaaatatccaaaataggcaaattcatagagatggaaagcagattagaggttaccagggactgtgaggaaggggaaatgtggagtcattgcttaataattacagagtttctctttggggtgataaaaacagattttttattaattaaatagataatgatgatgtttatacaacatcatgaatatacttaatgacactgaattgcacactcaaaaaatggttacaatggcaaattttatatttaccacaataaatttccctttaaaagaggaagacataggatccaggaagcaagacacaccaaggaaagagacaaaggggatttgcaggccagtcaccggtggctcacgcctgtaatcccagcactttgggaggctgaggcaggtggatctcttgaggccaggagtttgagaccagcctggccaacattgcaaaacccgtctctactaaaaatacaaaaaagtagctgagtgtggtggtgcgtgccgtaatcctagctacttgggaggctgaggcagaagaattgcttgaacctgggagtgggaggctgcagtgagccgagattgtgcactccagcctgggcgacagagagactcttacttcaaatgaaaaaaaaaaaggcagaggtggggacgggtttccagagtgatgggaaaggaagggccaggttcacctctggacagctgtctaggtgagagtaggaggatgaacggctctaagaaaaatggggggaagaaaacaaactgaaactggtatattaatgtatcaagaggatattttagctttatcagagagttatatacacataattatatataattctctaataattatatatattgaatatgttcaatttctaaaaccaaatgaagcaactataaattcaggaaaagctgaaatgtgtgtttggaggggcataatctaagcattcatgttccatagtaggaaagaagccacttgaaaatgttttaaactgaaaaatggaagaataacagtataaggctattaagatacatggaggtaaataccaaagaaagcagcttaaaaagatgaggaatggggcaaggaactgatctttttcattatttgattttacactttgtacaattatcactttctaaaaatgtttccagaaggcaaactggggcccatatctgggctatgtatgagctctgttgcccaagagtctgttagcccatgtgggtaatagatttttctctggtggccctgtgtctgttattccctttgcctatgggtgaatctgcaggtggggctgggggtgggaatagggctggagccagactaaggacagaaaagtgggctgaggaatgtcaaagtgaagggaatatttctggaggtagatttccattggttaagtctcttgcttttcccttatgcctgagaacatgacttttaccttcatacccaaacaacaaagtccagccagggagggtgggaggggaaagaaggaagagaggaagatgggaaggagacgcatatctgcagtggcctatctacacatatctgcacgagtgaccttggctatttcctgcagtatcactggggggaagggcaagttcagcactgctgctagccacgttggttggcacaacttgttacagtcatttggtagagagttcataattaacccagcactcacacttaacaggagttcatctgtcagaaatactagcggaaggccacaggatattaaagcagagatgtttgctgcagccttgttggaaatattgtgaaactgctaacagtcaaaatgtccatcagaaggaacagtaaatagggaataggggttgtgaaaactccacactatgaagtgtggtgcagctgcttaaaagatgtatatatgaaaaaaagtgaattactgatggcccattttctggaaaaaaaatggatgcagttatatagattaatacatatagattaagattaatatacatatagattaagacatagacaaaaatctggaaggattgtcacccttttttttttttttttgagatggagtcttgctctgctgcccaggctggagtgcagtggcatgatcttggctcactgaaagctgcatctcccaggttcatgccattctcctgcctcagcctcccgagtagctgggactacaggcactcgccaccacgcctggctaactttttgtatttttagtagagatggggtttcaccatgttagccaggatggtctcgatctcctgacctcgtgatccacccacctcagcctcccaaagtgctgggattacaggcattagccatggcgcccagccggattgtcaccctttagttaacagcagctgcctctggaaatgagattgaagatgggctggagggaaagcttttactttttatttgacattcttctgtaagttggaattatttgatacactttatgcaaccaataccagtatgtggcgtgtttgggggttttttaagcagctctggaagagcagaggagagggagcttggtggcacagcagcagcagcagcaggagctctggaaagggcaggaccttgtgcgctgccctgatttgctctgtgcacttgggccagctacctcccctatctggaccagggccagacacatgctgctatgtgtgttggtggaggtggggtgtgtggccatgcagggctcctccggagcacagcagagcagccggtgtttaaggcaccagaattaccagaaagttgttgacattttaatggaaaggcaatggaggaagcagtgtgaaagtcagcctgctcaggaggggtcactgggcagagctttccttacctgtccaggggtccaggccctgcctgtgccctgagttagaacccagggccggccaggcgcggtggctcacgcctgtaatcccagcactttgggaggccgaggcgggcagatcacaaggtcaggagatcgataccgtcctggctaatgcagtgaaaccccatctctactaaaaatacaaaaattagctgggcgtggtggtgggcgcctgtagtcccagctactcgggaggttgaggccggagaatggcgtgaacctgggaggcggagcttgcagtgagctgagatcacgccactgcactccagcctgggtgacagagcgagactctgtctcaaagaaaaaaaaaaaagaacccagggcctgggaagctttgggtcaacccccgagaaagccttccctgttctccagggtgaactcatctctggttcctgagcctcaaatctctgaagggcagagtggggcataggtttcaactcagctgtgattctcccagaacggtgccagggcagtgcttggtcgggtaggctgtgggtggcagtcttcggcttaacacaagaaattgccagaggctggctcagggggaaatgagctgcccagtcctggaagtttccatgaaatgactgaacataggggctggtggcccccattagggaaggggtggaggagggtgttgtgtgagaccaacctttcagttgctggttcactaggttccaagcgaaagggaagatgactcagcggagggaatcagggaaggctgtgtaggagtcagcacttaagctggaccttgagagagtgcggcagttccagtgttgaaagggacttcagaaaccgtccctccagcaggacacaccatccgtcaccaattcacatgaggctcagggagctgaagtcagttgcccatggtcacataacaagttgtgctttaaaaaattcagagagtcccccaggcagggcccatccaggagccagtgtgtgcagccagcttggtaattcaggtccagtggttaattagtaactggaaggccccgaagccagcttccagcaggcagggctgggaggttgaacttgagccggtttgggagccaggagcgagtgggtgacaggtcattcctgactgggaaggttgcttgacaagtcaggattgtgcctccagtcagaaggaccatgaagagagagaagagggcagagccgtgcatggggctgctccccaggacctgagcaggaacctggagttttcaggtgagaggctcacctgtgagcaggatacctgcctgctcgcctattggtctccagattgactagttacctagctaacatctttcctagtacctgtttactttctttccttcctttcttccttggcgacttctttcccttctccctccttcctttccttccttccctcccaactatctgctttctcagctgcctaattttcttcctccttaactaaccaacttacatcctcacttccttcccactgacttcattttttccttttctagctttctattgtcttcctgaaattccaggccgtgggctttgcagtcagatggcctgggttcaaatcctggttatgtcatttattaactgtcttgatcatgtcacttccctgtccttgcctcagttttctcctccttgaaacagggacgatgatagttcctaacccgtggggttgtgggaacaaaataagatcaagttggcacttgaactgggcaggcgtgtaaatgaacaagttacagtgaagacagggacagcagcaggagagggtgcatgggatcggagggtcatctggcttccaggaaaggcaatgagaacaggtgaaaaggtgagctggaaagaccaggtttgttggggaatgttccaaggagagagaactgtgtgacactgtcccacccccacaccccatttggcagggccagggagctgtaagcaggtccatgtaacagtgggacagagggaggcaagtctgggctgtggcaagttaggaaagggacaggcttgaggactcatggaggggcttgagtgggagtttgcggagtctgaagagttaggagaatatattgatgtccagcttctggccagaaaattagaacaccgtggtgcgagagagaagaaagccttaggaactgagggctgcttaggcatgggggtcacagtcaaggtgatgggggagggtgtgatgggccatgggcatgccaggttcccaccaggaactcagtacttgaatattaactcaacagcaatatcttgagaagctttacacaatagtacaaagataaaagttaaaataaccggccgggtacagtggctcacacccgtaatcctaacactttgggaggccgaggcaggcggatcacctgaggtcaggagtttgagaccagcctagccaacatggtggaacctcgtctcgactaaaaatacaaaaattagccgagcgtcgtgacacatgcccgtaatcccagctatttgggaggctgagacaggagaattgcttgaacccaggaggcggaggttgcagtgagcagagattgcgccactgcactccagcctgggcgacagagcgagactccatctcaaaaaaaaaaaaaaaaagttaaaataacctaacctaagaacccgctgtgaccttgggtcatgaccctgcagtctttttttggcagctgtgctcacaaatgtgtacgtgcagacatgtcttttgtttttcttttacaaaattggtacccctacaacacctactattttgaaacttggttttttgcttgatattgtatcacatgtatgttcctgttttggtttatataggttttatatagtttttggttgtgtaattttccactttatatatgtaccaacatttatcaattcatttattgattcattagtcaaattgtactgggcatctactatattccaggccctgtgctcagtgctgaggattcaatagttgaacaggaagtatttgccctcctggagctgatgttctagttggagatagaaaataaaaactaataaatacgtgataaggcatcagtgctacaaagtaaaatataaagtagacaaaatgtatagggaatgagcaggactggtatcagagtgactaaccatcctggttggcccaggactatagcggttttagcactgaaacccatcagtcccagacaaaccaagatgacttgtcacccgtaatcagtacaagcctctccaagaggtgactttaagcagaagcctctatgacgttagtggaaaacagccatgcaggtgcctgggggaagagtgttgtaggcagagggaaaactaagtgcaaggggctggaggccagagagcacttagtgtgtctgagggacagcaagagaaaggagagaggctgagggcagtcaggaaggaggggagtggaagccaaggaggagatggagacagcaagctaggtcatatggatctcataaaccatggtagaggctttggattttttttttttttttttttttgagacagagtcttgctctgtcaccaggctggagtgcagtggcgtgatctcagctcactgcaacctctgcctcctgggttcaagctattctcctgcctcagcctcctgagtagctgggactacaggcacatatcaccacgcccagctaatttttgtatttttagtagagacggggtttcaccatgttggccaggatggtttcgatctctgacctcatgatccacccgcctcggcctcccaaagcactgggattacaggtgtgagccaccgcgcccagctgaggctttggattttaattctaggtgtgttgagaaaccactggagtttttgagcaactaaggcacatgatctgatttacattttaagactcaccgtggcttttcatagagaaagattgtagtgggtaaatggagaagcaggggtcagtggagaagccattgcaataatccattcaagtgacaatgggggctcaggcagggcggttgcagcaatgatggtgagcagcaatggtttctggatatattttgaatggaatttcatgatggagtggaggcggagtgagggtgcaagctttctagaatgaactcaaagttgctggcttgaacttttgagtaggcggtagtgccattattgaggctgaagactgagggaggagcagactggggcagagtggaaggaatatgagtcaagacctttgttttggacatgttaacttcgagataccagccaggcgcagtgggtcacgcctgtaatcccagcaatttgggaggccgaggcaggaggattgcttaagctcatgagctcaagaccagcctgggcaacatagtgaaaccctgtctctacaaaaagtacaaaaaaaaattagccaagcctggtggtgtgtgtctatagtcccagctactcaggaggctgaggtgggagaatagcttgagccagggaggtaaagattgcagagagcctagatcactccactacactctaacctgggctgcagagctaaaccatgtctcaaaaaaaaaaaaaaaaaaaaaaaaaaagattgagatgctttggctgggcacggtggctcacacctgtaatcccagcactttgggaggcaggggtgggtggatcacatgaggtcaggagttcgagaccagcctggccaacatggtgaaacccagtctctactaaaaatacaaaaattagccaggcgcagtggcgggtgcctgtaatcccagctactcgggaggctgaggcaggagaatcgcttgaaccagaaagcggagcttgcagttagccaagattgtgccattgcactccagcctaggcaacagagtgagactctttcttaaaaaataaataaataaataaagattgagatgcctctagacatctgactagtgaattgtcaaggaagcagttaaatatttaaatccagagttcaggagagaatcagaactaggctgggcgcagtggctcacgcctgtaatcccaacactttgggaggccgaggcaggcagatcacttgaggtcaggagttcgagaccagcctggccaacatggcgaaaccccatctctacttaaaaaaatacaaaaattagccgggtatggtggcgggcacctgtagtcccgggtactcaggaggctgaggtgggagtatcacttgaacctgggaggcagaggttgcaatgagttgagatagcaccactgcactccagcctgggtgacagagcaagactctgtctcaaaaaaaaaaaaaagaaagaaagaaaaaaaaagatttgggaactgacaagtatagttggttaaaccactaaaatggtagtgatcaactaaagaacaagtacgtgtagacagaagcccaaagactaagccctgggataggcctgtgtttaaggataaaaagaggaggaaaatccagcacaagagatggaggaagagcagtcagtgagctagaaggaaaaccaagagttcctaaagccaaatggggaacatgagcacaccaaattcttcagagaagttgaataagatgaggatgaggaactcatcactggctttggcacatagaggtcactggtccacggtttcattgaagtgttgggatgagagcccatttggaacgggctcaaaagagaacaggaagaggactggagacaaggagtccagacaactctttcaaagagtttagctgaaaaggggtacaaagaaatgggaccatatctggacacggtatatggtcaagagagggagctcttgcagctggcaagtgttctgaagtgctctgtggtgggacacttaggttactattagcacaattattttgctgttataaatagtgctgctgaatgaaggccacatcaggatcttgtttttgaaaataaatgtccttgttctgggtatgtgttttgtcaacatgacatcctgctgatcatgaattggttccacatttctattttgttcaagatggaaggctttgatactgtgcactcaggttttctctggtcaacacttccagatcctccgcatttcagaacccacagagaacccctgaggcccctgggctcagttccctccctgaccaactttctgggccctagccccatgtgtccctcccctgtagtatactgtagccacacagaaagtttgagaagggcaggggctgtgggcccatcaactcctttattcttgagaacatctgcctacccctcgggatcctggggagaggaagggaccctgtgagaacctaatgaccgccccaggcagcaaggccttcatgagccagggtgctctctgggaccgtttcttacgcagcaggagagtcgtgggccaaccaggcctgccctgaggactgggccagagcccttgaggggcccgcagggaaaggccaaaaggaccaagtgctcattaaagaccaaggcaggctggactgagctagacacccaggctccaggttccttcctctgaaacatctgcaggtttttgggaggcgaagggctctcagctgccatggctgatgtctggggactttttcttcagctccagatggtctacacagggttcgtatacacaggccccctagccgcacgcatgcgtgcatgcacgcgcgcacacacatacacacacacaccccagagtaaattcactgatatacaccactatgaacacacacaatgacttacctatacacacatattaatagacacccatactgctcttaacacacaccttcagacatccacacagactcacactcacccacatacacacacactgacacagcatattcacatacaaagatacacactgatatgtaccacacagagacacgctgaaacacatccatatgcacaccacacacactgagatacagtgacacacacagtcacagatgcacagacatatgctgatgtaaatgtacaaatgtggtcacactgacacatacatgcaatcatctacgcagactcatagaaaccgacacaaatacctgaaatacacagccacagacagacacacacggaagcactctatgcacaaaacactcacacagtacacaccatgctgcacataccctgacccaaacagtctaacaagccctgagggtctccagggctgccctggggctattgcccacccctcccaccgtccccgctagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcaggtatgtgggaccagggaggccgggtcctggccaaagggccactggggtcagcccaggagagggtgtggcagtgttgtgggccgtttgcaggagcacacacgtctggcattggctaggggcaggctgcgcttccttagcagttctgcagcttgctcttaaggcttggcagggctgggcctctcagggaagcctgggctgggggatcctctcagttccccttcactttctctgttcccaagaaggccatgaggttggtgcctccaggacccccccttgtaaagataggaaatctctactcagagaggctgggctgcagcccaggccccacagtgggccaagactaaggtcttgagatgcgcggcaactgggctttcaggtgagatctctgctctcagcctttgccaagcaaggatgagactgtggggccccaagcaatctgtggcagggcctgggcaccctggccccgtctcccctgcagggtggaagcaaggaagacactattcctggccacatagatcagctggtcacaccttctgttgtttggccccgaatagatattggccagtcttgggtctctctgtggccccagcccaaggcttccagggcagctgcctttcctgaggcattgggcagaattccttgtggcaaggagatcgtagcacagagcccagctgggactgcgcacagtaattcagggttgccattgttcctctatgggagtccggagagcccagcctgtgcttcacaaggctatgtggccctaggaaggtccttttttaggccacaggccttccatctgtgaaatgggggatgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctctcatgcctgctcctccctgtccccccagagctgcctgatcattgctacagaatgaactctagcccagctgggaccccaagtccacaggtgagtggttcttggtcccccacccatcatcgggggctcacttcttcccgaggctaaggaaatctgtgggtcccagacaatgtcaggggctgagagggttactgcgagcacatagaaatgagccacttgcagggtgaatagagtagagatttgaaatagggcttcaagatgaactggaaaaatcatgagatttgtcatggagacacctgggtcgtatcccaacctggttgcctgtgagaccctgggcaactcctctctgggcctcagtttcctcgcctattcaattagcacaacagccagctgcctcccaaggctgttttgagaagtgggtaagatggtggataagtggatttgtgggtgggtagaaggagggagggagggagggaggcgggcaggcgggcaggtgaaaaaaaaagaaaagaaaaaggcaggcaggcctagtagagttgttggagaagggatcagggcctgggccaggagaaagggaggtagccaaggagtagggatctgctgatcataatcacttctttctttagccctccagggccaatgggaacatcaacctggggccttcagccaacccaaagtgagttctggtccctcaagcacctttcctacttgactcccctcatacctggctccccttgccttgggaataaaatccagattctctggtctagcattcaagactgtctgccatctgggcccaggacctttccccagctctatctcccacaaattccccagcctctgcccatgctgaaccctcttcctgcaatgccacctaaatgtctgcattgttagcaactccccacacttcaggcccttctgaggggctttgggtaccagaaccctgccttctatgcaggccttctgtgcagtatgtctggttttatctctaccctctgcctgttgtttaacttgaatttgagttcccctggggccagggtgaatcttacaagccctctttcggctgggagaacatggggttcttcgggggtgaggaggcatggctcctggaaggctctctgtatttccccattctaaagttaaaaagaagcccaggtttgttctcaggcaccaggtttccagacattgcaaatgctgatccgtgtttttccctcttcccccagtgcccagcccacggacttcgacttcctcaaagtcatcggcaaagggaactacgggaaggtgagtgacttggtgagggtgggaagcctgggtcttcccttctgcagcctcttccagcccctgctgccacttgtatgtatgaagagagagcactcgcacctgcagacaaaagcaggggcaggcgggaggccttgtactgctgttgggaagtccaaagtcacctacagggcctcaaattcatgtttcttctcaggtcctactggccaagcgcaagtctgatggggcgttctatgcagtgaaggtactacagaaaaagtccatcttaaagaagaaagaggtaccagagctcgggcacaggcatttcttcttctgcttctcaagccgcagcctagggtggctttcaaagatgggtcccacctctgacaggtccatgggcctgggtgcagaagtggtcacaacaaagggtagaggggaggtggtacgcaggatgctggcccttctcaaagaaagcaggccaagccatctcaccacagggctttcaggaaaaccagcctggctttgccttcccctgggaaacacaggctccacgatggacaagtcttctgcctgctccaagtgccaggctccccatctgtataatgtggagccccactttattctctctgaagacccttcatgccatcaggccatatggctggagtgcagtagtgcaatcacagctcactgcagcctcaaactcctgggcttaagcaatcctcccgcctcagcctcccaaagtgctggggttagaggcatgagctacatgcacagcacatcatggacttctttttttgttgttgagacagagtcttgctctgtcacccaggctggagtgcaatggcaccatctcagctcactgcaacctccgcctcctgagttcaagtgatctcatgcctcagcctccccagtagctgagactaaaggcacccgccaccactcctggctaatttttgtatttttagtagagatggggttttgccatgttggtcaggctcctggcctcaagagatccgctggcctcagcctcccaaagtgctgggattacaggcatgagctaccacactcagccccatcatggatttcttgatgcctcagctgacctgagttcctttaacacctgactccattagtaggccagagcaggcccagagagaggattgcataggaggttgggggactcagagaaaagagagattaatgttaacaaggtctccgtggggggtggaatgggaggtcttcctgagggaggcagcggtgcagctggccttgatggtgggattctgatggtctgaaaagagggtgcgacatccaggaagaggaaatagcatgagcaaatacatgaatatggatagtgtgtggcttctttcccttaggaactcagttatgtaggcatcacacatgctttgcttttcactccaagggcaagaagctctgatacaggggctagagctgtgcccacatgaactagcttaggatgaggctgaccaccctgagccctgaatactaaggaaggaacttgggcctggctctaagggcaatagggagccattgtgggtgtttgagcaggggcatgagaaagtcctgggtaggatgacccccacccacaagcttatatgggctgagccgggataaaagaggctgttgtgggctgtgacatggacccctctctttgtgactccacagcagagccacatcatggcagagcgcagtgtgcttctgaagaacgtgcggcaccccttcctcgtgggcctgcgctactccttccagacacctgagaagctctacttcgtgctcgactatgtcaacgggggagaggtgggtgggcccacagggaggcttccctgggctggctctcggctgggagctgtccatcccacatgcccactgcatgccaagttctggaatgatctcacttcatcttacaatagacccattttgtagctaaagaaactgaggttcagggaggtaatcatttgctcaaggccacccagcgcatacctggtagagtcaggacttgaattcaggtctgttagactccccaccataatgctttcttgccttcctcattcagagttgcccatagacgcactttgataggcccgggaaaggtcaatgctaagaggagctcgtggtcaaggtttctagtgctcccataggccacagggtgggattgactggtcactgtggtaaacagagacctcaaggccacctggtgacccagaagcacagctgggacaagcagagctccctcctgggcttcactctgtctctctggtcaagatgcaaaatgtagtggagctccagtcagtgaccccagatttaacctgcgtgatctcttgcctttgagaatgatgctaagaggggggtttttgtcctgcatccctaagtgaagggctttccatgccagcaaaatagtccaaaaacattggcccatgggtggatctaacctgagctcagtctgacagccgtatcatcatatcgcctggattgatggaaaagcataatctttgaaccacgcaggttcaaatgccagctctgccaattataagctacatgaccttgggcaagtcgcctaaccattctgacccctcctagcttcctcttacatgaaactagcatgacacttgtaccttgaaggttgtcatgaggattaaataagagatgtggaagggcctgacttggaacctggaacacaggaggtgcttaagcaatgctaactcatctcttcttctgctgactctttggacacccgggactgctgtgtggggcaggggccagcatgcactcttttggtaggaagaatgctgcaggtcagagagggagtgagctcgcagccgcacagggcggggagcaggtgcaccctagccctacagcagccacccaataactcctgtcacactcctcctcccctccagctcttcttccacctgcagcgggagcgccggttcctggagccccgggccaggttctacgctgctgaggtggccagcgccattggctacctgcactccctcaacatcatttacaggtgaggcctgcctgtggctcagagccaggaccaagcccttcttgctccaacagctaggggttgtgtggacactaaatcctgatgaaatcctggtggacttggtcctttgttttgggtggggttggagtctcctcctccgaggtccaagtgcccagcctttctgggctctccttctgcatctctggcaacctccatgaatagttctcctgccaggaccaccccccgcccaggtctccaactctcctcactaaatggctgagacacctcaaggctgttttctcttattttctgcagggatctgaaaccagagaacattctcttggactgccaggttggtgtgtgtgtgtgtgtgtgtgtgtgtgtgtgtgtgtgtatgtggttgcacaggtacactatctgaccatgagtctgtgtacatgggtgtgcatgcattgtacatgtatgcatataggtagaggaggcatttgagcatatgtgtgtgtgcccatgcacatgtacacacatacatatgtgcacatgagactgtacatgtatatgtgtgcatgcatgtacatagggggcaggggtggagccaggtggaggctggtggagtttgtcttagactgggctccatggaaacagactctgagatggagaggaggcagaagctttattggggaacattctcaagagataacacttttaaaggggtaaaaaaacaggattgggcaaaggaagaagctcacctgcattgtagttaccagtggggcctcagctgatcttgccggcagggggagggcctgagctggggtgggtctctaggattgtcccaaaatgagacaaagaggatgggcctttgtgcccctggacatggattgctcctagggacggggcataactttgggtgcgggcaatgttctagcagcagggggatggggataggcatggttcttctgtagcctggtttcagaagagggatccaggcagaaccccacagtatctactcattctaccttcctgcccagctgccacaaggtgtgattgctttctgagtccccagcctctgtctaggggttttctgtccacaagctgccactgtcgtaggggtgggtctgagtttgtgatgagctgtgggcaaacagtggaatgcccacccggccccctgtgctgctcctgacatccagtccaggagccctgtgttggagtggagcctccagcctgtgcctgggcatcagatcccacagctgctgccctggggtgtggcatctgggctttgggggttaggcctggccatacccttggctcataccaccctccagcccatgccctccgtcattctcagggacacgtggtgctgacggattttggcctctgcaaggaaggtgtagagcctgaagacaccacatccacattctgtggtacccctgaggtaagcgtaaacatcccaggagaggggaggtcatgagtgggtgaggccacagctcctgattagagccaacaggttacagtgaaggggactcactcctttgacccaaacacttctcctgagtgggctatacactgaactgtggtttcctcatctatgtaatgggggtaccagctctaggactgctgagacccagccagctagctgctggtgaagctctactgcagtgctatccagtagaaatagaaatagaaacgcaggctgggcacagtggctcacgcctgtaatcccagcactttgggaggctgaggtgggcagatcacctgaggtcaggagtttgagaccagcctgggtaacatggtgaaaccccatctctactaaaaatacaaaaaattagctgggcacggtgacgggcacctatagtcccagctactcgggaggctgaggcaggagaatcgcttgaatacaggaggcagaggttgcagtgagccaagactgtgccactgcactccagcctgggcaacaagagtgaaactccatctcaaaaaaaaagaaaaaagaaagaaattcaaaccacataaacactttaaaaacttccagcagccacatttaaaaagtaagaaagtaacaggtgaaattaattttaatgatgtattttatttaacccaatatatccaatattctcatttcaacataccatcaatataaaactggttgaaatattttattccttttttttttctaactaagtcttgaaaatctggcatgaattttaacacttacagcccatctcaatttggagcagccacatttgaagtgttcgatagccacgtgcagccagtggctgctatattgtacactactgatctgcagggtgaaggccacgtgcaacaagagggcctggcctgagtgttaagacctgggctggcaagtgtaaaccacaggtccgtgtccatcttccagctgccaagagcctggagggttacaatttgcagatctcagcagtcattcagacatgtctatatgtcctgccaaggtctctctgcagccctgaagttaaaacctttctttgggccaggcgtggtggctcacgcctgtaatctcaacactttggtaggccgaggcaggcagatcacctgaggtcaggagttcgacaccagcctggccaacatggcgaaaccccgtctctactaaaaatacaaaaattagccaggtgtgctggcaggcacctgtaatcccagctactcaggaggctgaggcaggagaatcgcttgaacctgggaggcagaggttgcagtgagccgagatcgggtcattgcactccagcctggtggacaagagcgagactctgtctcaaaaaaaaaaaaaaaaaaaactttatttgaactcccaccagtcttggaccttggaccttggacctgaaggggtccccagtggctagacagacgtcagggtgagggttggagggctgaggctacagactgggagactcctccccacctggcatgagacaggacctcagctgctctctttttctccatatgcttgaaaagctgggtcttagatctaatggcctcctcactttagttctagggtagctgatggtcggatgaactctctgagcaggagccatggtctgtgtttgggtatggtgggtggtgtttgctggataaagccagcgccccaaagcctgacagtccagccatcccttccttggacgttgctagggacgggaacaaaggatatggaaccccagctcatgtaggagacatgtggccccaacacatcacctttaccacgactcagccactgccatggtgttggggggcacaggcaagagtagccatggttgctcccattgtttgagggccagcacatatgttagcatcttagaacagcttctagcagggatttggtatcttcacatttttaggatgaaaaaaccagggtctgagaggttaaatgccctgcctgagaccacgtaccaaccacggctcaggtctgtgtgactctgcccttccctagaccccacacagtctctcagagcagcttttcctgttgctgagaccttgcccccgactcggtggcagagacaccaggctaagaagtcagtaagcctcttttttttgttcccaggttctcttcctcatgcaaggcatagagacatggtgtacatttatttatcaatagctcaggggtcaccccctccttcctgaccctctcgtctgaccctagggtttccagcacaaggatatgccacatgtacttttacttacactcacattagtctccacactgccctgtgagagtactcccggggccttccgttcccaggacacggatagccagttgaatgcctttgcaaaaatagaaaaaggcatcccctccgggcagactaattagaaaaagcaccccttgaaacaaaaataaagttgccggataatacctttgaactagtgttgcggcttggtgagtggattacagccatgagtgcagccccctttacccttttggctggtgcttttgtgtggtacacaccatgtaaattgcacaaagcagtcctggctgacctcttctacatccccaacccatggcaaagggccctgcagaaagcaggcctttgctgaatgactgatgcatgaacacacacacagccacagagcacacgtacagcagggtcagctcttggtcatcttcctccaagtgccttatttacagctggggcaactgaggcttaacgacttatttcaaataagtgtgtttccttctaacagtacttggcacctgaagtgcttcggaaagagccttatgatcgagcagtggactggtggtgcttgggggcagtcctctacgagatgctccatggcctggtgagtcaggggtagccatctacaagggccatctggctagggatgggtctgtctctcatgtggtctacacaagctctgtccaggaaaatgagcaagccatctcttcattccagactaaaaaagataacgccaaggtgaatatgcaaattattatttttttcaataatgttagtttaggccaggggcggtggctcacacccataatcccagaactttgggaggctaaggcaggtggatcacctgaggtcaggagttcaagaccagcctggctaacatgatgaaacaccatctctactaaaaatacaaaaattagctgggcgtggtggcgggcacctgtaatcccagttattcggcaggctaaggcaaggagaatcacttgaacttgggaggcaggggctgcagtgaaccgcggtcgcaccaccgcatatccagtctgggtgacggagggagactctgtctcaaaaaaaaaaaaaaaaaaagttagtttacaacacactgtctcaccttgggtgcctcaaaatagcctttggaggctgacacagcaggaaatggagttattcatattttgctgatagggaaattgagaccaagagagatcacagtcctgataggttgtggagccaacccctgaccccagtcctaggctgcctgcttaggtagaggcatgtgtagatttgccctaggccatgctttgctttgaagtggtttcaccagcatagcttggtccctaggaaggaacaggctctgtggattaaggggaaggaacagctggaagaggtgtgggaggaagaatagtaagaaagagaaggggaccctggatatggtttggggcctggctgtcttcctaactgtgccacataattgctctgagccttgttttcttacctgaaaaattacaactctcttggaggatggttatgaggctggggtgaaatgattaaggtgaaagtgcaaatgttgccaaatgcaaagttggtgcataagctagatgaaaagagatgggcctcacgctggtgggaagagacttctgaccttcctagcaactctctccatgtgccggaagcctggagtcctgtctctttccagtctgccatgcgagccattgcacaagacaggggtcatactgaatcctcccagccgcccaccttgctccaagtctccccgagcctgtgttcactttgcatgggtgatcctccagctgttctccctctctccccagccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttgtaggtgacctaccagtggagcactggcccccatggggctcgcagcttcctgcagaggcagctcagaagcacattaacacgcatcctgctgccttctaaaaccaggcactgctcacttgttcatttggaaattcactactgctactagctgactactttctccagtctagttctcttagtcaatcaatatttactaagcaccaactatgtgccaggtattgagctaggtgttagggattcaataggctgggtctctgcccttattaagtttggggtgggggccgggtgcggcatacacgcctgtaatcccagcactttgggaggccagaacgggtggatcacctgaagtcagaagttcgagaccagcctggccaacatggtgtaaaccctgtctctactaaaaataccaaaaattagctgggcatggtgttgggcacctgtaatcctggctacttagtaggctgaggcaggagaaccacttgaacctgggaggcggaggttgcagtgatctgagatcgtgccattgcactccaggcagggcaacaagagcaaaactccacctcaaaaacaaaaacaaaaaaagtttgggattgggggcaggcaaaaaacccaaacattatatacaattatcacaaggtatgacaagtgtcaggaagaaaatgaataatgagctgagatagacaataatgggagggggggcaaattaatagcggcatgatcagggagttctctctgaggaggtgacaattaagctgaggcttgacggatgagaaagaggcagccatgaagacagctgggcaaaggctccccagacacaaggcacagcatgtgcagaagtcctgctatgggaacaaggaggagagtggccagttttagggtgttttgagcagaggtctggcatgacctgatttaagtttttagaagattcctcgggcttctttgcggagagtggactgcactgcatctgctttttttttttttttttttttccgagacagagtcttgctctgttgccaggctggagtgcagtggtgcaatctcatctcactgcaacctcctcctcccgagttcaagcgattctcctgcctcagcctcccaagtagctgggactacaggcacccgccaccacgcccagctaatttttgtatttttagtagagacggggtttcaccaagttggccagatggtctcgatcttttgaccttgtgatccgcccaccttggcctcccaaagtgctgggattacaggagtgagctaccatgcttggcctttttttttttttgagactgagtctcgctctgtcacccaggctggagtgcagtggcacgatctcaactcactgcaacctccatctcccaggttcaagcaattctaatgcctcagcctactgagtagctgggactacaggcacccgccaccatgcctggctaattttgtatttttttagtagagacggggtttcactatgttggacaggctggtctcgaacgcctgacctcaagtgatctgcccgcctcagcctcccaaagtgctaggattacaggcatgagccactgcgcccagccagcacttgctttttacaaatatctgagtacttcttccttgccagaccccaggctgggcaaatgggatatagggataaatgattcatagtccattcttagcaaattcattatattcattcattaaagtggcactttaaaaataatcctactttttttattcaacacaaggtaatttggatttacaaaaagaaggccgcaatattttctcaccaggagtttgctttcttttctaacatagtggttaagatgaatggactaggccaggtgcagtggctcacatctgtaatcccaccactttgggaggccaaggcgggcggatcacctgaggtcaggagtttgagatcaacctggccaacatggcgaaacccggtctctactaaaagtacaaaaattatccaggtgtggtggtgggtgcctgtaatcccagctactcaggaggctgagacacaagaattgcttgaacctgggggtgggtggaggttgcagtgagctgagatgggcaccactgtactccagcctcggcaacagagtgagactctatctccaaaaaaaaaagatgaatggactatgaggcaaactacctgggttcagcagatccctccttcactgcttactagttacaggaccttggacatgttgcttaatttctgtgagccgcagtttccccattgtaataacagcacctaacacagctgttttgaagatcaaatggattagtattaatgtatgcaaagtactctcagcagtgtctggcacacaataagtgctttttaagtgtaccaaaagctttacattccagttactgtaaatcgtaacaacagttagggcatctgctgcctattcctggccagcttaaagaataggggcttccgtgaagatgtctcctgttccaagcaaaaatttgtatcttaaaaaaatatgtatgactcttaaaataagttatacattcacatagatcaaaattcaaagggtacaaaagagtatctagaaaaagtccttccagccacccagttcctcaattcagaggcaaccaatgttaccaatttcttgggcattctttcggaggcttttttttttttttttttttttttgagacagagtcttgctctgttgcccaggctggagtgcagtggcatgatctcggctcactgcaacctctgcctcccgggttcaagtgattctcctgcctcagcctcccaagtagctaggattacaggcacacaccaccacgcctggctaatttttctatttttgtagagacgaggtcaaccatgttgaccaggttggtcatgaactcctgacctcaggtgattcacctgccttgacctcccaaagtgctggcactaccagcgtgagccactgcacccagcctcttacggagatattttggatctgggttgttaaccagcccactggggttcctgatatagggaggtggagaataattatttgagaaacacagatagaggatgtgatggaaagaagttggtgccaatgttgattttgattaggaaaggtggtgaatcatgaccagggctgagtcctaaaatctgggtgtctgggaatctgaaggtcttcttgggggctttatttttcaaaccttccctagtgaattgatttagtctacttctctggtttgcatactggaaaactcaagatgtactgaagcagagtgaggggaggggtctccaagctcccactggtactcccccacccccagagcagattctgatgtattattcactgacacccccaaagcctagcaaagggtcggtgcccagagaagatgctcagtaaatagttttggaataaacagatgctgtagtggggagaagggtttggattctggatgatgggagaggcttggctgcaaaactctcttgtcccaggaaactagccagaactgcaagttaatttccagttgacagccagttgcttgtggagctctggaggatgtgggggtgaggtgagagcacccatggggagggctacttctaaccagaaccttttttctgcacttcctgcagcttgagattaagaaccatgtattcttcagccccataaactgggatgacctgtaccacaagaggctaactccacccttcaacccaaatgtggtaagaggtcacagcattctagactctggatttccggggctgggggagcttgctatgcttgccaactctccttatctagatggaaaacttgggggtccaagaagctcagtcatttgtcctaggctacacagtcagttagagacagaactgggcctgactacaggtgcagctcttggataaacagccatgttgctgctcctttgtcttgagcaccaataaataactctggctgcagagacttttacagtttgtgaagtgctctgtttcgcacagcacacccacatagggccaagccctttagagatattttatccttttctatttatagactttttcctgataataaaaatgacatatatccttataaaaagtatgtaaaacactggccaggcacagtggctcacgactgtagtatcagcactttgggaggctgaggcgggtagatcacttgaggtcaggagtttaagaccagtgtagccaacatagtgaaaccccatctttactaaaaatacaaaaattagccagacatggtggtgcacacctgtaatccctgctactcgggaggctgaggtgggagaatagcttgaacctgggaggcaagggtcacagtgagccaagatcatgccattgcactccagcgtaggcaacagagggagacttcatctcaaaaaaaaaaaaaaaaaaaaagggaatgtatgtaaaacagaaaagtttaaagtagcagtggcgaaatgcttattatctcactacttaagggaaaccactggcatatttccttccagtcacttttctatgtgtttttttttgtttgttttgttttgttttttttcttgagatggagtctcactctgttgcccaggctggagtgcagtggcacaatctcggctcactgtaagctctgcctcctgggttcatgccattcttctgcctcagcctcctgagtagctgggactacaggcgcccaccaccatgcccggctaattttttgtatttttagcagagatggggtttcaccatgttagccaggatggtctcgatctcctgacctcgtgatccgcccgcctcggcctcccaaagtgctgggattacaggcgtgagccaccgtgcctggcctgttttgttttgtttttaacctaattaggtcctactttatagtatctatatgtgtgtgtgtgtttattcatctatattatcttcctccttttttggctaaaaactatgttataatttcctcatgtcataaaaaattttataaatacaatttttagtggctgcataatatttccatcttatgttggtaacataatttacttacccatgttcctaatggcaatcttatggttgttactatgttttttctttatcatgatgtgctgatgaacagctttaagtatatgtctttgcccagaattctggtcatttctttaagatggattccatatggggaattcccaatgctaatgttttttagattctttttttatttttattttatttatttatttttttgagacagagtctcgttcgatcgcccatgttggagtgcagtggcacgatctcaggttcaagcaattctcatgtctcagcctcccgagtagctgtgattataggcatgcgccaccacgcctggctaatttttgcattttcagtagaaacggggtttcaccatattggccaggctggtctcgaactcctggccccgagtgatccactcgccttggcctcccaaagtgctgggattacaggcgtgagccaccgcacctggccatttttaggttgttgattcacaccaccttttcactgtgtggaagggagaaccatctacttcctaccagcggcacttgctggagagttctcatcttgcttgcactctgaagcatgtgtggttattgttttttactttgcaaatttggtaagtaaaaaacagcatctcttaattgttttaatttatatttctttgtcttatagtaaagatggttagttttttaaatttatttattttttgagacagggtctcactctatcacccaggctgatgtgcagtggcatgatctctgcctattgcaacctccacctcctggggtcaagccatcctcctacctcagcctcctgagtacctcagcctcctgagtagttgggaggtgggtgccaccacacctagctaatttgtattttttgtacagatgatgtttttctatgtagcccaggctgatcttgaactcctgggctcaagtgatccaccccctcagcttcccaaagtgctgggataacaggtgtgagccaccacacctggccagtttttattttcatttttatttttatttttattttattttattttattgaggtggagtctcactttgttgcccaggctggagtgcagtggcacgatctcagctcatggcaacctctgtcttcttggttcaagcaattctcctgcctcagcctcccgagtggctgggactacaggcatatgccaccacacctggctaatttttgtatttttagtagagatggggttttactatgttggccaggctggtcttgaactcctgacctcaagtgatctacccaccacagcctcccaaagtgctgggattacaggcatgagccatcgcgcctggcttttatttttatatttttgagatagagtcttgctctgttgcccaggctggagtgcagtggcacgatctcagctcactgcaacctctgcctctccaggttcaagcaattctcatgccccagcctcccgagtagctgggactacaggcgctcagcaccatgcttggctaatttttttgttgttgtatttttagtagagacggaatttcaccatgttggccaggctggtcttgaactcctgacctcaagtgatctgcctgccttggcctcccaaagtgctagttttgcaatgttaattggtagtggcagtgtgaatgaaaggagtcctattggaggtgggcgtgtgaagctgtgtggtctacctgtaaagcatggtgccaagccccttccatcgaaacagcctgcatatcaaacactgccaatgttaattcaccatttacatttctcatttgtttaattacctattcatgaacttgtctttgggcactggatcagataggatacactcgggccaggcaccagaaaagcttcttttcgttgggattttaaaaagacagtgaagataatgtcgaacttataccctggagagagaaccatacatggaatactaggcagagatgaatggactttagaatgagacactccggagctggattcctggttttgtcacctaccatttgtgaggtcttcagtaagtctctttagtatcattttcttctacagtcacacaactaataagggccaggatgcacattctgatcttggaactctgagtgctgggctgggactaccttgtcttgtagccttattgagaagctagaaactgtgatctgtttggctccatagcccgacttgcacactaaagcagatttgcaagcccttccccttcctcacctgcttacttcataaaacccaggcctcctccacagagagactgtattggttagctcttggtgtataacaagcaactccaaagctaggtggcttaaaacaacaatcttttggctgggcatggtagttcatatctgtaaccccagcactttatgaggccgagctattagcattgcttgaggccaggagttcaagaccagcctggtcaacatggcgagacccccatctttatagaaaaatagaaaattagccaggtgtggtgctgcatgcccagctactcaggaggctgaggtgggaggctcgcttgagcctgggatgtcgaagctatagtgagctgtgatcatgccagtgcactccagcctgggtgatgggcaaaaaagaccttgtctcttaaaaaaaattattttgttcggattctatgtgtttttttttaagtctgagtcaggccagctggtctctgtggagctctctcatatctgtggtcagctagcgggacagttggcagttgttgatctagaattgcctcactcccatgcctgggagttggcaggcagccagggcaactgagttcttcatgagcctctcatgctccagcaggctagtctggggctgttcacatggtggcatcagggttagaagtacagcaagagagcaactcctgatgtgcaattttcaagcctctgcttgtgtcatatttggtaatgtcccattggcctaaccaagtcatatggctaacttacattaaaggaatggagaaatagactccacctctagatgggaaatggagaatttgtgaacatttttgtaatctccctcacaggtcttcctccaaaatagctaaagcagccccagtcaatctccaccatatcaccctattttctcttcttcataggacctatcaccatcctaagttacctatttgtacatatgcttattatcaatcctcctaccccccacacaatgtaagctccatgaatgcaggggctcactttatcttgttctcctgtgttcccagcgccacgaacagtacctggtaggcattcagtaagtgttatgttgattaactgacttgcctgacgattggtgtggaggcagaataccagggggtgagaggaatcaaatgatcaatgtaaatgcacaggaaagtgacagtcaagtatggatgactgtgaagcatggggcactcacagaggcctgacatccctctctgaggatctgggctcctttggcagctctgaccccggtgttttcttctcatcattggcttttattgacagacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattgggtctgggtgcctggtatctgaaccccttcttgtctccagagaaccccctattttatgagacttcatgggggggcaataactacctccacttaagagtacctgaaaatgctagacactgactttcccagcctccccttagctagggccaggcatggggaccagggataaacctgtgccacattttgactcagggaagggatcgggagcgctcttttgtgtggtaactgtgataacagtacccgcaaaattgagttcctggtgtagaagtgacaaggatgcaaactgtagcagttggtgctcagtggcagcaacgccatcagaccagccctgcaatgtcattcctggaagcctcaagtgttttttttttttttaagacagtcttgctctgtcgcccaggttggagtgtagtggtgctatctcagcccactgcaacctccgcctcctgggttcaagcaattctcctgcctcagcgtcctgagtaggtggaactataggcacgcgccatcacacctggctaatggtttgtattcttagcagagacagggttttgctattttggccaggctgttctcgaactcctgacctcaagtgatcctcccgcctcagcctcccaaagtgcgggtattacaggtgcgagccactgcacccgcccaagcctcaagtcttgtctagctttccaaatgatctgagaatttctgatcctttttaacacactccttttttgcttaattggccaaagttagctttagatcgcctgcttatgcttggctagttgctgtactagactcttccatgtctgttacaaattttccatccaaacaaccctgaggtaggaattattactgtcccctttttaccaatgaagatgcagagtcagagaagctgttccttgcctgaaggtcacatagctaatgagggccagagctgggacttggagccctacaagctggctccagggctctcacattgaacttttgtgctgatctgcttctcaccctggctattaggtccaggcagaatgactgccaaaatctctagtgaggagctaagtcaaaagttggctggaacaagccaagtataagaaatggggtattgaagaggagacattgaacgggatgccgctcctggtctgagcctggctgccaggttcatgccgtgctccaccgcacattggggagctcagagctggacagagctggaggctgctgcagacttgatgcctagagcttcctgtccaccatggagctccatatgttcaagattagtcttttttttttttttttttttgagactgagttttgctcttgttgcccaggctggagtgcagtggcacgatctcgactcaccgcaaccttcgcctcccaggttcaagcaactctcctgcctcagcctcctgagtagctgggattacaggaatgcgccaccaggcctggctaattttgtatttttagtagagacagggtttctccatgttggtgaggctggtctccaactcccgacctcagatgatccgcccacctcggcctcccaaagtgctgggattacaggcgtgagccaccgcacccagccaagattagtcatttctaaagataattctgatcggacagaacgtgagcggtaacacctcataaattcagaacaccctgcacttgtgggatggattgtgcttccttacttcagtggaaaagtggttcgtttcggctgggcgtgctggctcacacctgtaatcccagcactttgggaggccgaggtcaggagtttgtagaccagcccggccggtatggtgaaaccctgtccctactaaaaatacaaaaatttagctgagtgtggtggtgcatgcttgtagtcccagctactcgggaggctgagacacgagaatcacttgaacccgggaggcagaggttgcagtgagccaagatcgtgccactgcactccagcctgggcgacagagtgtgactgtcttattaataaataaataaatacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccagataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaacatgctacaacctatgtttattgagcacattccaagttttatatgcattatctacaatcctcactataagccagcatttagaaattatgaacttcagactgggcgcagtggctcacgcctgtaatcccagcactctgggaggccaaggcaggcaattcacgaggtcaagagttcaagaccagcctagccaaaatggtgaaaccccgtttttactaagaatacaaaaattagccgggcatggtggcgggtgcctgtaatcccagctacctgagagactgaggcaggagaattgcttgaacccaggaagcgaaggttgcagtgagcggagatcatgccattgcactccagcctgggcaacagagcaagactcagtttcggcaaaaaaagaaagaaagaaagaaattattaacttcgctttacagataggatacatttgctcagagattatgaaaactgcccaaggtcacccagctggtacaagtcacagcgaggaattgaacttggtgacaactactgattctaaaagtcttactcttgcttttttggggggggaagcggggacggagttatgctcttgttgcccaggctggagtgcaatggcgcaatctcagctcactgcaacctctgcctcctgggttcgagtgattctcctgcctcagtctcccaagcagctgggattacaggcggccgccaccacacccggctaattttttgtatttttatttttattttattttttatagagacggggtttcaccatgttggtcaggctggtctcgagctcttgacctcaagtgatccacctgccttggcctcccaaagtgctgggattacaggcgtgggccactgcacccggccaaaactcttactctttctgcaatctctaacagtgggagaaatgctctgggcaggtgctgtagcaaacactgactgcatatcaggcagaaagatcccaagatttgtcccagccttcaaatgggacggcctactctctcttcagtgagaatacttcatttccattattaccctaactgcaaactgtattcacccaattctgcaccaaaatacagcatccccaagaagagaactttttttttttaagagacagagtctcactctgttgcccaggctggggtgcagtggagcgatcatggctcactgcagcccgaactcctgggttccagcgatcttcccacctcagcctcccaagtagctaagactacaggtgtgtgccaccatgcctggctaattttctttttttatttattattactattattattggagagaaaaggtgttactgttacccaggtcccagactcctggcctcaagcagtcctcccaccttggcctcccaaaatgctgggattacaggcagaagccacttcatctgaccaaagagaattctcaaatcaccctgttctccactttctttttgagacaaggtctcactgtgttgcctaggctagagtgcggcggcaccatgacggctcactgcagcctcaacctcctaggatcaatcaatcaatcctcccacctcagtctcccaagcagctgggactacaggcgcgcgccaccacgcccaggtaatttttcctatttttagtagataccgggtttcgccatgttgcctaggctggcctcaaactcctgggctaaagagatccacctgcctcggcctcccaaagtgctgggattacaggagagagccgctgcgcccggcccgtctccacttttaaaatttccagtgacagaaattgtggaaagcaacacgagttgtatgtgttttaatatcctagattcgaagacaaacataaatgtaaataaaaactgtcagagctctctgcaatcttcagtttgggtcttccaggctgctgcagcgttgttcacaaatccacacacctctaaaggcaggcacagagcgctttcctgggtagtcgggtggcctgttggtagttgcaggcttctggtttcccatcttaatggcgatggcagggcaacctgtattggtggtgcttttgcacaagcagttctttctgccgggaacgcccttccccagcctttgccttaatgaataccactctctcttcaaatctctgctcaacaggggcgcctttttgaccagcttagtcgttagactccctaatacagttcatagttttcacatttttgtagaatctattcaagttctaactccccgccatgctcgccggcgctcaagcctagtaccatggcaagcaaagatgcggagttaataaaacagaattatacggtttatcattctcaacactaaacctgcgcacccttttccgttaagtagttcctaatagtccagcacagccttccgcccggccccgccctcgcctggctccactctgctcctgcgctttgggaatcgaagctggggcgttctccaacccccccgcgctggaagccttcactattctcctccctgtgggtggagcgaagtttgggcacttgggtcctaccgttgttattagtctttactcgtaattgatactaaagaacaaaattaaatgggtttatttttggtgaaaagttaattctccttatgtttggatttgcccctcatgcaccaaatggtacagccccacatcagtcaggctgcctacccctgacgcctgcgacggagaggcgccttccgtgctgtcgtcatcacgtcggccggagctagcgctgcgtcctgggccacgcctcccggcgcaccgacgcgcctctccggttactaagcggccttggatacctggccgcgggatgctgggcggcgtcaggtgagcggtggtcgctgggcctcaggtaaagggcgccaacagtggtgggccggctggggcgttggtgcggcctgggagctggcgagggactcgccgcactcttcgaggccgctgggccggtcatagaacatccagggtcccccggggtgaagtaaactgtgggcgcggacgtagcccgggttcctggcgccccggctgggcgcccatctccacggcctcgggtggtgcaggtgtttagtcgttccgctgactatgaaagagcatgggacgaggaatcgtacagtcttaatctctcttctgtcgtggctgcgacccctcggtattcatgtgggaaaatactgatttgactggtaatgttattgaagagaaagcgagagaatggtttggcagcgttacccaaatatttgttatttttatagttttaaaggccttatactattattaaggaaatgcatttctggctaagtctgacagtacaggaacgcagacctgctactctcaccaggggctgaactaacagaacaaaaaaagatagatgtatcacggtggtgggaccatggagggggcagtttttcaactggacaaaatgatgttaaagtgcttaaagaaggataaatatgtgaaagtagccaggaaaattctaaaattaatgctaataagggagattagctctccagaaccaccagatattataacataaaggtatagcaattaaactagcatagaagatgggtgcagcagtgtgggcccgtagtcctggctacttggtaggctgaggcggcaggatcccttgagcccaggagtcagagaccagcatgggtatcaaaaggaaaccctgtctctgaaaataaataaattaatttaaaaagtttgggactcagcaggagcttacaggtagataaaatatattagaactcagaataagagcgatttatatatagggatttattatataggcgaggtggtactgtatttcaaatcagcattgaagagatgaattggggtcaggcagcttttttagcaatttagaaaataattaaaccagtcgagcgaggtggctcacacctgtaatcccagcactttgggaggccaaagcgggtggatcacttgaggtcaggagttccagaccagcctggccaacctggtgaaacaccgtctctactatggcgcgcgcctgtaatcccagctactggggaggctgaggcaggagaattgcttgaacttgggaggcggaggttgcagcgagccgagattgcaccactgcactccagcctgggtgacagagcaagactatgctttgaaaaagaaggaaaaaaaaaaggaatgaagcccattttgagcaccacaataatttccaaatggactaaaatttaaatgttaaaaaattacatcacgaattagccgggtgtgtttgggcgcctgtagtcccagccgcttgggaggctgaggcacgagaatctcttgaatctgggaggcagaggttgtggtgagccgagatcgtgccactgcactccagcttaggccacagagcagactctctcaaaaaaaaaaaaaaattacatcatgaagtactgaagtaaagcattgttgaatttatttataatcttagaatgacaaaaaactcttctaagtgtttcatgtcatccagaagccaggaaggaaaagattcatacttttaactctataaaatttaaaatctatatggcctgcaaaattcaaccaaaccaaaaaaactaccagaagccaaataaacttatgaaaatgtttgtttaatgatcaattagaaaattatgaaacccgactgggtgcagtggctcatgccagtaaaccagcactttgggaggttgaggtaggaggatcacttgaggtcaggagttcaagggcaacatagcgagaccttgcttctacaaaaaatttaaaaattagctggacactggtgcgcgcctgtagtcccagctacccatgaggttgaagtgggatgattgcttgagcctgggaggtcaaggctacagtgagttgtgattgcagcactgcactcccagcctgggtcacagagtgggacttttatctcaaataataataataagaagaagtttttaaaaagaaaaatttaaagagaaaaatgatcaagagtacctggacaagaaaatcagaagaaatacaagtggcaaaaatctatagcaagagacaactatctcactaacttcaaagtggaaattaaaacagtaatgaggggggttttttggccctttattggcaaacatgacaaagactggaaataggattgtgtggaaacagaagggtgttagtggaaatataaatgagtataactttttggagggcaatttggaaatgatttactcagccattcaatagataagaatctctacaaatatgcaaattgcagaaaaacatgttgtttaacattgatgtttttagtattgttttagaaaatatttgataaaagatgtcagccagtagatgactggttaaataaattatggtagatccataaaatgaatactgtgtagctgtttttgttgttgttgttgtttaaagacagggtcttgctgtgttctccaggctggagtgcagagtggcgtgattgtggctcactgcagccttaacctcttgggctcaagcaatcctttcacctcagcctcccgaatagctgggactacagatatgtgccaccatgccctgctaattttttttgtagagatgtggttttatcatgttatccaggctggtctggaactgctgagctcaagcgatcctcccacctcagcctctcaaagtgctggagttacaggcgtgagccactgcacccagccctgtgtagctgtttaaaagaatatggtagatccatgtgtactgacaaagaaagatgtcaaatatacaaggttaggtgaaacaggtgtttcagaataatgcatatggtaagatcctatttcataaaataaaactgtaagttaatatatgtataaaaagaatctcgagctgggtgcagtggctcacacctgtaatcccagcactttgggaggccaaggcaggtggatcatgaggtcaggagtttgagaccagcctgaccaacatggtgaaaccccgtctctactgaaaatacaaaaattagctgggcatggtgacacgtgcctgtaatcctggcaactcaggaggctgaggcaggagaatcgcttgaacccgggagatggaggttgcagtgagccaagatcacaccattgcactccaacctgggagacagagcaagactccgtctcaaaaaaaagaaaaatagaatctagaagactataccctgcgcttaacagtagttagcagtaatgaatcaggatggaaacatggtcttgggacacaagagcagggtgatggcagggcagagccataggtgtaggctgttgggaggatctgggcaagaggcagaaagcaaaagcgggtaggggagggctgggttggttttggtcttaggtttctgtgctatgcttttgcatttcactctcaacctttgagaattgtaggagtttcctagataggtttcagttgtataccctttcttgataaattagtagtagaaggcaactatttattacttttagggtctttggaatattgtttattgattttctgatcccatctttcttccataaggtaaccatggagaaagagctgcggagcaccattcttttcaatgcctacaaaaaggagatatttaccaccaacaatggctacaaatccatgcagaaaaaacttcggagtaattggaagattcagaggtgactgaccatgtatattgttttcccttctaaatgatattgtcctgctgataaagctgagaagtctttattttcttaggtaacatagattgtttaggtgggagaagctcaatttaaagattattcagaattaggtctggcgtggtggctcacacctgtaatcccagcagtttgggaggctgaggcgggcggatcacgaggtcaagagatcaagactggccggcacggtggctgacacctgtaatcccagcactttgggaggccaaggcgggtggatcatgaggtcatgggttcgagacaagcctggacaagatggtgaaaccccatcgctactaaaaattaaaaaaaaaattagcgaagtgtggtggtgggcgcctgtaatcccagctccttgggaggctgaagcagagaattgcttgaacccgggaggcagaggttgcagtgagccgagattgtgccactgcgctccagcctgggcaacagagtgagactccgtctcaaaaaaaaaaaaaaaaaaaaaagaaagatcaagaccatcctggccaacatggcgaaaccctgtctctactaaaaatacaaaaatcagctgggcatgatcgtgcgtgcctatggtcccagctgctcgggaggctgaggcaggagaatcgcttaaatccaggaggcggaggttacagtaagccgagattgcgccactgcactccagcttggtgacagagcgagactctgtctaaaaaaataaaaaaacattattcagaatgaaataaattcttattaaaacgtctcttgggcaggacgcggtggctcatgcctgtaatcccagcactttgggaggctgaagcaggcagatcactagaggtcaagagttggcgaccagcctggcctacatggcaaaacctcatctctactgaaaatacaaaaattagccagacatgatggtgcatgcctataatcccagctactaaggaggctgaggcacaagaatcccttgaacccaggaagtgaatgcctgcagtgagccgagatcatgccactgcactccagcctgggaaacagagggagactctgtcaaaaacaaaaattaaaaaaaaaatgtctttcgaaatcagcaattaggatattattaaagcagcatattattaagttgttttccaaatcacaagccaaaagattattctaattatacacatgtagctttttaagatgttagaggctttcttcatattttgactcaggtcagtactagggaaaggaaacatgagaattaaatgagaataactttgtgtatgtgcatgtttttcttaataggtgaggatatgtaatcatacaagctaatggtagggctgattgaattagtagttgcagacttccttatgctttagcatggcttgatttgaacaccttgacttactggaagtatttgaacagaggccagatgactctggggcaggcctgtagagggaattctcactttgggagagagactggaccagttacctctaaatcccttcatctctgagcctctgtggcctctgcttccaaatagttaagagactaaaataatacataaattggtttaaattatggacttcatatttgcttttaaaattgtatttccagcttaaaagatgaaatcacatctgagaagttaaatggagtgaaactgtggattacagctgggccaagggaaaaatttactgcagctgaggtaagaaatatccactaaagaaggaatatggtgaaatgattaggagtctgagctttgaaataccggatttgaatcccccttcaccacttactgtgtggccttaaggtagtcacttcatctctcttttcatcatggagttgtgatgattaactgagatactccatgtaaagtaccaaacacatagtgtgggccaattaaatattagccacacttctttttttttttttttttttttttgagacagagtctcgctctgtcgccgaggctggagtgcagtggcgcaatctcggctcactgcaacctccacctcccgggttcaagcaattctcactgcctcagcctcctgagtagctgggactacaggtgcccaccaccacgcccggctaatttttgtatttttggtgcagatggggtctcaccatattggccaggctggtctcaaactcctgaccttgtgatctgcctacctcagcctcccaaagtgctgggattacaggtgtgagccaccgagcccagccagtagccacatttctttgctatatttttgctttgaaaataggaaaattccgccaggcgcggtggctcacacctgtaatcccaacactttgggaggccgaggcaggcagatcacctgaggtcgggagttcaagaccaccctgaccaacatggagaaaccccgtctctactaaaaatacaaaattagccaggcgtggtggcgcattcctgtaatcccagctacatgagaggctgaggcaggagaatcgcttgaacctgggaggcggagcttgctgtgtgccaagatcgcgccatctcactccagcctgggcaacaagagcaaaactccatctcaaaaaaaaaaaaagaaagaaaataggaattcatttaaaataaaagtgtttattattctagttcatggaatggataaagaatgataaatgtaaggcccagaatacaaatgacaagtattggtgagaatgggaagttattggaacccttccacactgatggtgggaatgtaaaatgatgcagtcaccatgaaaaacagtatggtagttcctcaaaaatttaagcataaaattgccatatgatggctctgtgtggtggcccacgcctgtaatcccagcactttgggaggctgagaagggtggatcacttgaggtcaggagttcgagactagcctggccaacatggtgaaacctcatctctactaaaaatacaaaaattagccgggcgtgatggtgtgcgcctgtaatcccaactacttgggaggctgaggcaggagaatcacttgaacctgggaggcggagttgcagcgagcagagatcgggccactgcactccagcgttggcaacagagtgagactctttcaaaaaaaaaaaaaaaaaaaaactgccatatgatctagcaattccacttctgggtatatgcccaaaagaatggaaaaccagatctcagagatagttgcacacctatcttcctagcagcgctattcacaatagccaaaaggtggaaatagcccaagtatccatcggcagatgagtagataagatatggtatatacatacaatggaatattattcaatcttaaataggaaggtaattctgatacatgctacacatggatgaatcttgaggacattatgccaaacgaaaataaggcagacacaaaaagacaaatactgtatgatttcacttatgcaagcatgaggtacgtagagtagtcgaattcgtagagacagaaaatagaagggtggtggttgccagggcctgggggaggtggggaatggagcgttgctgcttaataggtatagagtttcagttttgcaagatgaaaacagttctgcagattgattgcctaacagtgtgagtatatttaatactgctgaactaggccaggtgcggtggctaacacctgtaatcccagcactttgggaggctgaggtgggtggatcacttgaggctaggagtttgagaccagcttggccaacatggtgaaacctcatctctactaaaaatacaaaaattagccgggcttggtggcacatgcttgtactcccagctacttgggaagtggaggtgggagaatcgcttgaacctgggaggcggaggttgcagtgagccgagattgcgccaccgcactccagcctggcgacagagaccctgtctgaaaagaaaaaacaaacaaacaaaaaactgctgaactatatacttcagaatggttaagatggtaaatttaggaaagattaggtgtgttttttcacagtcaataaaacaaaaaacccagaacatagaaagagccattttacagagaatgggaagtacctttgtgctgagagagaatatggggaatagagaggttgaggcagggcaaggccaatgtggtccttagattgaggcaggccaaggtctcctgctgttactctgggtggtgccatggggaagaggtccactggggagcatttctagtgcactttgtttctcaatttgattgcaaagtgaccttcccccgctgggaatggcatggagagggacatgattgtttgatcaggttaattgacagaaggagtagaaattaccattgggaatgtggaggtaaccagcaactcctacccactgagaccctgagggatatgtacacacagagggcagtggcctgcagagcaacactctattgcttgttgggcttcggctccatctccccatccacctagcgaagccaatgagagagttggcctgatgtttgccagggaccaaccagcctcaggaacacaggggcatccaaagagagggtcagaacctggtgcctgggccttttcccaagtggagatgggtgccaggccaagccttagtttgggcttccaggcatggtaggctgatgcatccaagagacacaagtccttcgagaggcaaatttgatgtaactttagcctaataaaacgtcctctcccagaccagtccctgacaccataccttctctttagagttggagtgaggtgggaagaaaagggaaaaaagctgttagctttttttctaggaatcagcattcctttgtgttacagttcttccaatgggctcatgcttgtgagatcactgctttccttgtcattgctgctggcctcctagactgttacccctggagagctgtgtgatgcctttttcatgttgacttccagaaacttctgtgacaggacagacatcatatgtctgatattagatgctagtatcatgctagaaactaggctgaacagtctttccttatttccacctcaactacattgacgcattacactagctttgtggtggtattcagttacgaccaggtaaccacgtggctgagacgagtattttccaaccctaacagaccagcatccacctatattacagatgccaactttgttaccctgaattgaaatgcaaagataatctaacccaccaccattaaaaaagtaaagcaatataacttcctaactttaatgtacagaaattaaaggatgatttataaaagaatatgtgtatttcaaattgtaaatgtttatgcatatatatactagaagaatatacatatttcagtttgttaatgcttggtcatacatgcattagaacacttctttatgtttgacattttgaaataaatgtttaataagtatgtagaactccgatgaatgggataggtacatatgcagactggtggaagtgatgtattggcaattcaaatcatgagccgtgttgctgtcggtgatgtgatttttccaaaatactgactaactcttggtaaagttctatttttttttttttttcctgagacggagtcttgctctgtcacccaggctggagtgcagtggagtgatctcagctcactgcaagctccgcctcccgggttcacgccattctcctgcctcagccttccgagtaggtggtactacaggtgcccaccaccacgcccggctaattttttgtatttttagtagagatggggtttcaccgtgttagccagggtgatctcgatctcctggccttgtgatccgcccgccttggcctctggtaaagttctgttaataaaaagagtataattcttctctcagtttacatggtagttgggtacctccgaattcagtatatgttaaatcgtgcaaaaaatactttgtacagtatttacatagaatttgagctgggcgcagtagcttactcctgtaatcccaggagtttgggaggccgaggcgggtggaacaccagacgtcaggagtttgagactagcctggccaacatggtgaaaccttgtctctactgaaaatacaaaaattagccaggtgtggtggcaggctcctgtagtcacaactactcaggaggctgaggcaggagaatcacttgaacccaggaggcgaagtttgcagtgagccgagatcgagccactgcagcatgggtgacagagcaagacttcatctcaaaaaaaataaagaaattggagttagattttaggctgagcttcttttgtttgtttgctttttcttttttaaacctccgtgactatctgagaagatattcaaatgctgtggaatagttctttactgtgtgggactggtctgaatattgcaggaccttaacttccctgcccttcacccgctaaaatgtccttaaacattaatattatggcattaatattttgccatattaatattaatattatggtgatccagaatacatgctagatggtttaaatgcctccactgagagccactggcctggatcatccagtctcgattacaggaaatacctcacatttgctgccacactaacagtgtgaatgcattctaagccaatttctaaaattcaagtctgcaaaattaatctttcttcctgtttttgccataaagaaataagaaacctccagtttgtaccaaatatccattcttttgttagaagggtctcacttacgtgtatagctggaaactgggtcataattcatgtaagctccttcaacttttgcccacctgtgttattgcacaccacatccttcatgtatctttttcttaaaatgccagatggccaataggacacagtagataccaataactactatatactcattgcatttaggcaacatggacaaatcccagaaccacataatcatgaaaaccaagtcccagtagaatttcccaagcaaaagctatgttctgagaatatatattgcaaactagacctggcttgctattatcagtcatagaacatagcatatatttagggctgtctgggaagaggagtttgagaggaaatcaaaaggaaggaaaaggaagatgaatttagggagagattcagtctgttgttcagggtccaggatcatgcagttataacccatttgttttgtttttctgttgttgttccaaaaaatgtttactaaggatctgttacacacctagtaacaggtcctaggactaacgctagggatcaaagtcaaatagcacatgatctctccactcaaggaaccgatagtctaggggaaatgacacaaatggaccatctaccaataatgatcaatgttctaagttccacatttctacagaaacacagaaaagaggcattggattattgggtccagaggaaatggactttgagctgatttttattttatttatttatttatttatttatttatttatttattttgagacagagtcttgctctgtcgccaggctggagtgcattggcgcattctcggctcattgcaacctccgcctcccaggttcaactgattctcctgcctcagcctcccgagtagcggggattacaggcatctgcccccacacctggctatttgtatttttagtagacacggggtttcaccatgttggccaggctggtctcgagctcctgacctcaagtgatccacccacctcagcctcccaaactgttgggattacaggcatgagccactgcaccccgccttaattttgattttgaaataattcattttttattttgttttgtttttttgttgtgtttcgtttttgagatggaatcttgctctgttgcccaggctggaatgcagtggtgcaatctcggctcactgcaacctccaccacctgggttcaagcaattcccctccctcaaccttccaagtagctggggctacgggtgcataccaccacgcctggctaatttttgcatttttagtagagacgggggtttcaccatgttggccaagctggtctcgaactcctcacctcaagtgatccgcctaccttggcctctgaagattcatttgttttatacagtgtggggaaggcagggggagaggaaaattcagggagcatacaagagcgagagggccgtgctgtggcaaatctagtctgggcagtagtttccaaagtaggatgcatgtgatgaatcagtggggtgccaaaaggaaattatgtttattattcatattttcattacccttaaaacatttcctttttgggagttgttttgaattataaagtacatattttatatagagatacatacatattgaatgtatttatatacatgttcagatttttttctgctggagtgcttgatgaagaaagttgagaaactatttgtctggaccacccaccccagattttctcaggctagaccagcaagatcaaccctagatttttctcccttccccagctttgtgaaaatgagagagcttccaggagataagcagaaaacatgcgtttctctctatggtttggttggtcaatgaccttgaacagaattcctcccaggtgtggtatgaaatgacttcatcctgatatcctctgtgggcagtcaagagaaggcattgtctaaatcagtggttcttaactaggggtgattctatttcttcttctcctgagggaacatgtggcaatctcaagagacatttttggttgccaggggaaggtaggtacaactggcatctagtaggtggagaccaggggtgctgctgaatggagaactgagtgcttcctttagttaagtttttcacttttgacttgctctctagatagtcagctttgaaattgtcaatttactttgagtattttggagctttatgctcaaagacaagcttggagatcctacatagagagtactttttatcttatatacatttatatgtaaatgccttatagatttgaaatatgtatttttcatctagttaaggtcttattcatggtatttcgggcaaaagtctttcaagtatattcatagattgcttttttcctttgtgtagtttgaaatcctgaagaaatatcttgacactggtggagatgtctttgtgatgctaggagaaggtggagaatccagatttgacaccaatattaactttttactagaagaatatggaatcatggttaataatggtaattagtattattattttcagtagaggcagtacttttctatctattatttgatatcatagccctctaggtccagtggcataatggaaaaagccctgggctgtgtgtgcgtgttttaatgttccattctcatcagcagtctgagcctcctaggcttgggctgcttccatttataaagcgagatggattggaaccaagttccagggtgcccttcaggtcaaaattggtatgagtctataatatcgaatttatttctaacctaaaatatacctccttctctttttccctcatagatgctgtggttagaaatgtatatcacaaatatttccatcctaaagaagctctagtttccagtggagtcttgaacaggtaagcatgttgaaagcagaaatatcttggcaaggcatcgtcgctcacacctgtaatcccagcactttgggaagccaaggtggatggatcattttgaggtcaggagttccaaaccagcctggccaacatggtgaaaccccatctccctgtctaaaaatacaaaaaaaattagccaggcattgtagcaggcgcctgtaatcccagctactcgggaggctgaggcaggagaatcacttgagcccgggaagcagaggttgcattgagctgagattgcaccattgtactctggcctggctgacagagcgagacttcatctcaaaaaaaaaataaagcagaaatatccttacacataactctcatttcttctacataaatcttccctcgtctcttctcatacattcttttcactgccctttcttctttcttgcctttttgttttgtgttattataatttattttactatattactactactcattcatcaaattatttttcttcatcttttgaaacttacttcacattcaatttattttttgtttatatatatatgtattttttgagacagagtcttgctctgttgctcaggctggaatgcagtggtgggaacacagttcactgcagccttgacctcccaggcttaagcaatcctcccaccttagcctcatacttgctgtactaatgaatgcagtgtgaaattctcaaattttttttgtttactagattttaatttttcttcttcaagggaaattagccgagctgcaggaaaggctgtgcctgggatcattgatgaggaaagcagtggaaacaatgcccagtgagtgtgttttctgatgccacatgaggaagatgtatcattttggagtcttctttttcaaaatgaaaagagcttttgtttctggttacaaaaataatcagaatttgaacagttcaagaggaaaaaagtagaagctctgcactgtaagtccatgctcctccccctgaaggtagtcttaatatagtatttaggcccagcatggtggctcacgcctgtaatcctagcacttttgggaggccgaggtgggtggcccacctgaggtcaggagttagagacaagtgtaaccaacatggcaaaatcccatctctactaaaaatacaaaaattagccaggcgtggtggtgtgcacctgtagtcccagctactcgggaggctgagacaggagaactgtttgaaccccggaggcggaagttgcagtgagccaagattacgccactgcactccagcctgggcaacagagcaagactccatctcaaaaaatatatagtatggtatttagatttctaggtttttttttttccatgtataaagttataggtgagtacctcttcatttttaatgactggattaaattggatatatcccagtttatctaaccaactccctattattggacatttaagtagtttataatgtttttctttaataataccacctaatgtttgtcaagcatcgactgtgtgacaggcatgtattacctcatttaatccttacaactctggaaagttagagatgagatacagagatgtaattgcccaaatgcacatgactactctgtgtcagaacttagatgcaaacataggcagtctattctagagcctgcactcttaacttctgttccgtattgttgttatagacaattttatagccgggtgtggtagctcactcctgtaattgcagcactttgggtggccaaggcgagtggatcacctgaggtcacgagtttgaaaccagcctggctaacatggcgaaaccccgtctttactaaaaatagaaaatttagctgtgcgtggtagtgggcgcctataatcccagctactggggaggttgaggcaggagaatcacttgaacctgggaggtggaggttgcattgagctgccatcgtaccattgcactctagcctgggggacagatggagacttcgtctaaaaaaaaaaaaattatatttgtcattatagataataaagcacaaatgaacatcttttttttttttttttttgagatggagtctcactctgtcacccaggctggagtgcagtggcatgatctcagctcactgcaacctccgcctcccaggttcaagtggttctcctgcctcagcctcccatgtagctgggattacaggcatctgccaccacacccagctaatttctctatttttagtagagatggggtttcaccatgttggtcaggctggtcttgaactcctgacctcaggtgatccacctgcctcggcctcccaaagtgctgggataagtgaacatctttgtatgtacagttttgtgcacttgtggtagtatttttttttttttaattgatcattcttgggtgtttctcgcagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaggcatctgtttgacaaagcacatcttgcaccgcccttaatccatttaaccctgagtggacacagcacatgtttcagagagcacagggttgggggtaaggtcacagatcaacaggatcccaaggcagaatttttcttagtacagaacaaaatgaaaagtctcccgtgtctacttctttctacacagacacagcaaccatccgatttctcaatcttttccccacctttcccctctttctattccacaaaaccgccattgtcatcatggcccgttctcaatgagctgttgggtacacctcccagactgggtggttgccaggcagaggggctcctcacttcccagtaggggcagccgggcagaggcgcccctcacctcctggatggggcggctggccgggcggggggctgacccccccacctccctcccggacggggcggctggccgggcggggggctgacccccccacctccctcccggacggggcggctggcctggcgggggctgacccccacctccctcccggactgggtggctgccgggcggagacgctcctcacttcccagacagggtggctgccgggcggaggggctcctcacttctcagacggggcggctgccgggcggaggggctcctcacttctcagacagggcggctgggcagagacactcctcacctcccagacggggtcgtggccgggcagaggcgctcctcacatcccagacggggcggcgtggcagaggcgctccccacatctcagacgatgggcggccgggcagagatgctccgcacttcctaaatgggatggcatcctagatgggatggcggccgggcagagacgctcctcactttccagactgggcagccaggcagaggggctcctcacatcccagatgatgggcggccaggcagagacgctcctcacttcccagacggggtggcggccgggcagaggctgcactctcggcactttgggaggccaagacaggcggctgggaggtggaggttgtagcgagccgagatcacgccactgcactccagcctgggcaccgttgagcactgagtgaacaagactccgtctgcaatcccggcacctcgggaggccgaggctgggggatcactcgcggttaggagctggagaccagcccagccaacacagcgaaaccccgtctccaccaaaaaaaatacgaaaaccagacaggcgtggcggtgcgcgcctgcaatcacaggcactcggcaggctgaggcaggaaatcaggcagggaggttgcagtgagccgagatggcagcagtatagtccagcttcggctcggcatcagagggagaccgtggaaagagagggagagggagaccgtggggagagggagagggagagggagagggagtgggagtattttttagggtaaatttctcagcattgaaatttctgggtcagaggtcttccaacagatgggttaccaaatgtaatgtgttaccagatgtctctcagggaggtggtaccacttacagtccctatgagcacacacctttttcctctcttgccagcatggagtattctagtaaacatcgtatctctttcttttaatttgcatttttttaaattattagtgcataggatgacctttaaagtctattggctgattgtatttcttctgtgaacttcatgttcattgctttttggccatttttcaattgatggtttgtcttttcgcattcatttataatacctctgtactttgaaatattttacccagtaaaaattgacattcttatgtagttaaagcatgttacaaagttttagtagtgaaaataatgtggtccgggtaccgtggctcacccctataatcccaacactttgggaggctgaggcaggcagatcacttgagctcaggagttcaagaccagcttgggcaacatggcgaaaccctgtctttacaaaaaaatacaaaaatttagccggtcgttggtggctcgcacctgtattcccagctactcaggagactgaggctggagaattgcttgagcccaggaagcagaggtggcagtgagccgagattgcgccgctgcactccagcctgggtgacagatgagactctgtctcaaaaaatatgtaaataaaatgaaattaaaaaataaaataatgtgattggctgtgtgcagtggctcacacctataatcccagcactttgggaggtcgagatgggccaatgggttgaggctaagagttcaagaccagtctgggcaacatagtgggaccctgtctctacaaaaaaaaaaaaactgaaaattagccatatgtggtggcacacacccataggcccagctactctggaggctgaggcaagaggattgcttgaacccagaaggttgaggctgcagtgagccgtgatcatgccactgtactccagcctgggtgacagagcaagactatctcaaaaaaataataaaatgtggtcatagttcagaaatagttttaaaaaaataaataatacagattaaaattagaccaaaaacatatatggagggtggggattatttgtgtatagtaaaagtggcatttcaaatattagagatggatggcataattctgggtaaacatttggagaaatagtttcattttcataccacaccccaaaatgtattctggataggctaaaatttttaatattaaaaatgaaagcatatgccggacgcggtggctcacgcctgtaatcccaacactttgggaggccgaggtgggcggatcacctgagatcaggcgttcaagaccagcctgaccaacatggtgaaaccccatctatattaaaaaaaacaacaaaattagccaaggatggtggcgggcacctgtaatctcagctactcaggaagctgagacaggagaatcacttgaacctgggaggcggaggttgcatttagccgagatcacaccattgcactccggcctgggcaacaggagcgaaactccgtctcaaaaaaaaaaaaaaaaaaaaaaaattagcctgtcgtggtggtgcatgcctgtcatcccagctactcgggaggctgaggcaggagaattgcttgaacccaggaggcagaggttgccgtgagccaaaatcgcaccactgcactccagcctgggcaacagagcaagactccgtcttgaaaaaataaaataaaattaaattaaattaaattaaattttaaaagaaagcatagaagtacttaaagaagcccaggtacgatgactcatgcctgtaatcccagcattttgggagactgaggcaggcagatcacctgaggttaagagttcaggaccagcctggccaacccccatctctactaaaaaatacaaaacttagccagacgtggtggcacaagcctgtaatcccagttactcgggaggctgaggcaggagaattgcttgaacccgggaggcggagggtgcgatgagccgagattgcatcactgcactccagcctgggcgacagagcgagacaccaacgcaaaaaaaaaaaaaaaaaccttaaaaaaaataagtgaatattttaaattcttggagtagggaagacctttcttagtagaaacaaagtcaagtcataagggggaatatgtatagcaatataattcacagagttaatatttttgactgtcaagaatcaatctaggctgggcgcagtgactcacgcctgtaattccagcactttgggaggctgaggcaggcagatcacgaggtcaggagatcaggaccatcctggataacacgatgaaaccctgtctctactaaaaacaaaacaaaacaaaattagccaggcgtggtggcgggcacctgtagtcccaactactcgggaggctgaggcaggagaatggtgtgaacccgggaggcggagcttgcagtgagccgagatcacgccaccgcaatctagcctgggcgacagagcgagactccgtctcaaaaaaaaaagaaaaaaaaaaaggaatcaatctaattatttcactttgtgtcagcttatccaactggtataggtaaaagaactgtagacttggaattagaaggaattgttagaagttcctgattccctctcttacttgccaagggtgacccaaggcatagtaactgttagtgtctgtttccctatctgtgtagtggggataatgttaaccttacaaaattgttggaaaatttcagtaaggtgatatttgtgaaagtgctttgtaaagttgaaagcctagtgccctacttgttgttgcgttatgactttgtaattaattatagtgaagggaatatgtctagttgttcctttcctggattatccaggaaacagcttcctggtagactttgaggtatggactagtcctgcttcttgctttgaggtatctttgcctgttggagtctcagattctcctttatccttatttcctgttatgtcccttctcccttctctcactctgctgtagccacactgactttgtttcaatccttaaataagtgaagcttgtattcatcttagggactttacacaagctattccgtcttttaggaaaactctttctgaaacttttcactgagctaatcttattcattcacatggtttggaaagttctgttttggggatgggtgtttaagtttatacttagtcttatcaaaatgtcagtctttttttttttttttttttttttttttggagacagagtttcgcccaggctggagtgcaatggcaccatctcatctcactgcaacctccacctcctgggttcaagcaattctcctgactcccgagtagctgggattacaggtgcccgccaccacacccggctaagttttgtattttgagtagagacagggcttcaccatgttggccaggctggtcttgaactcctaacctcaggttagtctggcctagtctcattgatttttttagtagtaataaaagaaatacaggagtgtaaataatagcaaataggccggtcacagtggctcacacctgtaatcccagcagtttgggaggctgaggcgggtggatcacctgaggtcaggagtttgagactagcctgaccaacatggtgaaaccccatctttactaaaagtacaaaaagtagccgggcgtggtggtgcacacctgtaatcccagctgctcgggaggctgaggcaggggaattgcctgaacccaggaggcagaggttgcagtaagctgagatcacgccattgcactccagcctgggtgataagagcaaaactccatctcgaaaaataataataataataataatagcagatagtttttatcttgctactcaagtgtccgttctcccttatgccttgagaatcatcttccattgattgcattttgggaaaatgtgggggatagatgtgcattgacctccatatgactatttctcccacctactttttcttcctccatggacaactgcttgttttcttctgcttctggcccagagatcatgggctgtaatccaccttgctgggatactgctggagtaagggtagaaggtggagtttggagaatgtgggccaagtaccacttctctttcatagtatgacaacaaaagtcatagggtagatgagattttactgaaggaatggggaagattaacaccagagggaggccaggcccggtggtttatgcttgtaattccagcactttcggaggtcaaggtgggcggattgcctgagctcaggagttcaagaccagcctgggcaacatggtgaaaccccgtttctacaaaaaatataaaaattagtaggtgtggtggcatgcacctgtggtcccagctactcagggcactaaggcaagagaatcgcttcagcccaggagattgaggctgcagtgagccatgttcataccactgcactccagcctgggcaacaaagtgagatcctgtcttaaaaaacaaaacaaaacaaacaaaaacactagagggaaataattttaaacttaagccaaaaagaatttttgttgtctaaagaaaaagggaaattaaaatctctatgaggaacccctcatgggtgcttcccctataccccctcccccagtttctaaccttacgccctggtgttgagatctgtgtttctctccattctgagagcacttccttcaagctttgcagagctccatctttgagtaaaaccctaacccctcctacatgggttggcttcaccccagaatctgcaccccacctttgctcctctatcccacaccctctccaggagtacattgccccaggtcagaccaattcactctagataatctaagacaagtctttgttaggacagtggagagtagaggagggactccaaagcagatctgtgtagaagtgtccattatagcgtatatttatgcctctgttcatgtgacatttaactggtaacatacccatccagtgatatacattaattcttagagatagcactagccaaacctaaggaagaagaacgtatttaccagtaagatattattatgcagagcagcttgagttcagttcttggatgaggccccatcctcttcctcctccctccatcaggggcttctttagttctcccagttacagtcacttacactttcctgttaatttactttcatgttttttaaaatgctttattaaatgtgtagctagagttgtcccagtttttaagttaacaaaccaaagcttagaaaaaattttttgtttgataatgaatcaaagagtgttactcagctgagcaccgtggcacacgcctgtaatcccagcactttgggaggccaaggtgggcagatcacttgaggccaggagttcaagaccagcctggtcaacatggtaaaaccctggctctactaaaaatacaaaaattaactgggcgtgatagcaggcactgaggctgcagaacagcttaaacctgagaggcggaggttacagtgagccaagatcgcaccactgcactgcagcctgggtgactgagtgagactgtttcaaaaaagagtgttactcaagaaacattgagattattttcagaatttttgtattcatgtttttaaaatttgaatgtgtttctttaatttcttacagggctctcacctttgtgtatccttttggtgccacattgagtgtcatgaaaccagcagtggcggttctgtctacaggttctgtctgcttcccacttaacagacccattttggctttctatcactcaaaggtacagcttttcttagatatgggtatagatgttatttttattgttgaaataataaaaaccaccttaccatttccagaaggcttctatatgttttctcactggtcttcctgccagtcctgcaaagtagcatttcagctatatacattttgcttatggggaaacagtggattgtccagtaattgatgaagttaaggcctaaacctagctcttattattctaaacccgaagcttttccactgtagcatgaggctacctgtattataactttttttttttttttgagatggagtctctgttgcccaggctggagtgcagtggtgcaatctcggctcactgcaagctccacctcccgggttcacgccattctcctgcctcagcctcccgagtagctaagactacaggcacctaccaccacgcccagctaattttttgtatttttagtagagacagggtttcaccatgttagccaggatggtctcgatctcctgaccatcctgcctcgtggtccacccgccttggcctcccgaagtgctgtattataacttttaaaataacttttttttttttttgatcccatggcagcatattgatgaaaataacttttaatcctgtctgtgactatgggctgtcaccctcagtgtaaagagaatacattcaggaacagatggagttaacatattacacaaaatagcacagaattatgttgctgttagtttatactaggaaaatatatcagaaaactatttttccagttattatcctagagaccccatagaaatgtgggcacagctagtcccaggcagtgacccaacatcccactgcctttctttttctttttttttttttttttgagatggagtctcactctgttgtgcaggctggagtacagtggcatgatcttggctcactgcaacctccgcctaccaggttcaagcaattctcctgcctcagcctcccgagtagctgggattacaggtgcctgccaccaagcatggctaatttttgtatttttgggagagatggagtttcactatgttggccaggctgatctcgaactcctgacctcaagtgattcacccaccttggcttcccaaagtgctgggattacaggcatgagctctgttgcccaggctggagtgcagtggcgcaatcttggctcactgcaatctctgcctcccgcctcagccttccaagtagctgggattacaggcctgcaccaccacaccctgctaatttttgtattttaatagagatggggatttaccatgttgcccaggctggtcttaaacttctgagctcaggcaatcccccccacctcagcctcccaaagtgctgggattataggcatgagccactgtgcccagcccccactgcgttttaattcacattttgctgaatttaccttcatctgccccctaagacagaattcaccagctgatctcctaattttttttctagggacctaggtgtctctagctctgaacaatcctatttttctttgtggtacctaggaattacctttcccttcttatttaaaagctctcgggctgggcgtggtggctcacacctgcaatcccagcactttgggaggccaaggtgggtggatcacttgaggtcaggagtccaagaccagcttggccaacgtgatgaaaccccgtctctactaaaaatacaaaaattgaccaggcgtagtggctcacgcctgtaatcccagcactttgggaggccaaggcgggtggatcacgaggtcaggagattgagaccatcctggccaacatggtgaaaccccctctctactaaaattacaaaaattagctgggcgtggtgtggtggcacgcgcctgtaatcccagctactcaggaagctgaggcacgagaatcgcttgaacccaggaggttgcagtgagccgagattgtgccactgcactccagcctggaggcagagtgagactccgtctcaaagaaaaaaaaaatattgaaaaattagccaggcacggtggcaggctttgcagcatttgcttttaacctggtacaaatcagagggttttttttaccaattttttaaaaatgtatgtaatgtgtgtatttatgtctcttgacatctctggcttagtataattcttttcctggggaagttataactatgcctgttccctgtatgtgatgtagctaaaaaaaccgatttcattttgtatttttactattgaactggttttctcattacaaaagtaataatgtgctcattgttgggctgagcgtggtggctcacaactgtaatcccagcactttgggaggtcaaggcgggcaaatcacttgaggtcaggagttcgagactagcctggccaacatagtgaaaccttgtctctactaagaatacaaaaatattagcccagcatgatggtgagtgcctgtaatcccagctactccagagactgaggcaagagaatcacttgaaccctggaagcggaggttgcagtgagccaagatcatgccactgcactccagcctgggcagtggagcaagacactgtctccaaaaaaaaaaaaaaaaagtaatattgtagaaatgttacaataattgtagaaaaaatgaacaatacagagataaagcaaaagaaaaaaaattcccccatcgcactactccaagactctaagacagcccaggttgacatattattcactttctcctacttttgctttgccttatttttatttatttgcctcgtaagctttaaagtagaatagcaatataatttatagtataggtcaggcatggtgactcatgcctataatcttagcactttgggaggttaaggaggtaggatcacttgaggccaggagtttgataccagccttggcaacatagtaagacctgtctctacgaaaaagttagctgagtgtggtgttatgctcctgtagtcctggctacttgggaggctgaggcaggaggatcacttgaacccaggagttcgaggctgcagtgagccatgattgtgccactgcactccagcctgggagacagagtgagaccctatctctaaaaatgggaaaaaaattatagtatactttttttttaaccgaatgatgtgttggaagcattttcccatgttactgaaaaccctttataatatgaaatttaactgctgaagaaggttgcatcattctgaattacttttttgtgaacatttggatttatttctaattttttgtgactataactacacaactgggcatagaattttttatgtttcagactgcttttgttgcatatgttaatagtttcagcaacaatgtgtgaaagaacttatttcactaaaattcgactagcgctgtttatatcatattttcatatttatttatctgataggaaaaagtactttgtttttatttgttaaaagttacaagtattgaaaatttttcttattaaccagtcattattttatgactctctcatgcttgtgccttagttttctggttttttttttttgagacggagtctcactctgtcgcccaggctggggtgcagtggtgcgatcttgcttcactgcaacctccgcttcccagattcaagtgattctcatgcctcagcttcctgagtagttgggattacaggcatgcaccaccatgcctgactaatttttgtatttttaatagagacggagtttggccatcttggccagcctggtctcgaactcctggcctcaagtgatccacccgcctcggcctcttaaaatgctgggattacaggcatgagccactgcgcccagccttgccttagctttctttgagactgagtcttactctgttgcccaggctggagtgcagtggcgcgatctcagctcgctgcaacctcgcctcccaggttcaagcaatcctcccgccacagcctcccaggtagctgtgggagtacaggtgcgtgccaccaaccctagctaatttttgtatttctagtagagacagggttttgcctcccatgttagctaggctggtcttgaactactgatctcagggtgatctgcccaccttggcctcccaaagtgctgggattacaggcgtgagccactgcactcagcctgctttagctttctatttggatcttacttaaatacttttttttttggtacccataggtatctttaattgtacagactgtctttgagtttatcttttttccctttaaaattatgatcttcgtttataagataaacaacaataggaaaatgctgtagaatcaatttaatttttttttttttttttaatttttagagacagggtttcccaggctggagtgcatggtgcagtcatagctcattgtaacctcgagctcctgggctcaagtgattctcctgccccagcttcccaagtagctaggactacaggtatgcctcaccacacccagctaatgtagaattaatttatgttagttttcgttaaagccaaataaaaaaatatagaagtatctaaaatgagaggcaggttaaagtgtagtagttattatagttggtctttcttttttttgttttttgagatggagtctcgctctgttgcccaggctggagtacagtggcgcgatctcagctcactgcaacctccgcctcctaagttcaagcgatttccctgcctcagcctcccgagtagctgggactacaggcgcatgccaccacacctggctgatttttttttatttttagtagagacggggtttcaccatgttggccaggctggttttgaactctcaacctcaggtgatccgcctgcctcggcctcccaaagtgctgggattacaggctgatccactgcgcctggcctatagttggtatttctaaactttaaaatctgggtgtgaattggcactcttcagtatataagacagttgctagcatgattctaataagtgtctgggtactaggatacatgagatgcactttcggatttgagtatctgaccctgctttgtcatcaatagaaccaaggtgggaagctggcagtgcttggttcatgtcacatgttcagtgatcaatatttggacaaagaagaaaacagcaaaatcatggtaagctttttcttttgtcatattaatatacaatgtgtattattttcatgtcatttaaaaaaatactggtaagtttatttgctcatttaaaagcagctactcagaacccattatatgccaggcactgagaatacaaagtcgagtcaggcatagtcccagtccctgctttggaaaagtttgtaatacactgagagagagagagacaaattagtaaacccagaagggtgtttctgagcatgtcaggtggggtgggagctgagcctggagaagcggagaggaacaggctcaatagcagtatcacgtgtaaggccaaggagcttgaacttgatgctgaaagccacagggagcccttgggttttcagcagccttgagcatagccagatctgtgtttcttctttttttgttgttgttgtttatgaaagaacttctagaatgttttggaaagattcttctgtcagttgtgtggaaagtggaaaggaggaggcagcctagagccaattaggaaggtggtggtgtcaccaggcaaggagaaatggggacctgaattacgggagtcaaggtgtgagtggagaggaggggctggtaggaatgggaattaggaaaggctctgtagaggactactcactgactgatgtggcaaataaagtaaaggcattgcaattttgtcaaaaaaatgccaagggaacatgtcttacggaagatggcagagtagggaagcacatgtctgtacagcatgtgccagagctgtccattggtgattccagtgagagaaagaaacgccttataattgttatattgggagattgataaagatcttatttctgtggaatttacatgaagtttcaatgtctctagacacattatgggagatctagatattctacttttttttttttttttttttttttgacatggagtctctgtctgtcacccaggctggagtgcaatggcaccacctcagctcactgcaaccatcgcctcacgggttcaagcgattctcctgcctcagcctcctgagtagctgggattataggtgtgcgccaccacaccaggctaatttttgtatttttagtagagatgaggtttcactatgttggccaggctggtctcgaactcctgacttcaggtgatccacctgcctcagcctcccaaagtgctgggattacagcttgagccaccactcccggcctaggtattcttcttttcaaaagttttaatttcagactgtcatcacagtaaatagggattaattcaggattgtgaacaaaggttaataaattttagcttgtggttagaggttagggtgcttaaagatacattataaatttctgataataaaagttgcattatgctggtcatggcagctcatgcctgtaatcctactactttgggaggccgagacaggtggatcacctgcgatcaagaattcgaggccagcctgaccaacatggtgaaaccccatctactaaaaatacaaaaatcaaccaggcctggtggcaggcacctgtaatcccagctcctcaggaggctgagacaggagaatcgcttgaacccaggaggtggaggttgcagtgagccaagattgcgccaccgcactctaaccagggcgacggagcgagactctgtctcaaaaataaaaggtgcattagggtgaagaaaacctttgagttctcatatgattgcatcaagacaaggctggctacccttttctgaatcactggtttaatctttcttcctttatcattcttcttgatttaattctctagtcctgaccttcagctttttcaaataaccaactgtcctaattatatacttttttttttaatttaggatgttgttttccagtggctcacgacaggagacatccacctaaaccagattgatgctgaggacccagaggtagacaccgaattattagaaacttttaaatgaaaaatgagtccagcttctcagtaccacttctcacagctcaaaaggaatacatgactgtcttaactcatctgtaagacagatggaacgaaggaatgatttgggggagatgaaggccatattgtaaaaaataagtcaataaacaatatatgtaattaatcatagaattaattggagggggagcatacatacatacagtatgtatataaattagaatttaaattatgggcactctggcccagactttcaaaatgagcatctgcagaaaaatacttttttcagaaatctgaaattttctcataaagaaacaaagagtatcagaatttatgttgtaaactataattttgttgcctttagatttaacagttctaaaggcattataataatattcatcagacaagggaaagtggtgaaaccagcacagtgaaatcaccaccggctcttggaccttatacaggttctttctgaccatttttcatcctagttttctttattaaaaaaattttttattgtatttattttttgagatggagtctcgctctgtcgcccaaggctgtagtgtagtggcacaatctcagctcactgcaacctctgtctcctgggtccaagcgatccttctgcctcagcctcctgagtagctgggattacagatgtgaaccaccatgcctggctaatttttgtatttttagtagaggcagggtttcaccattttggctaggctggtctcaaactcctgacctcaagtgatccacctgtctcagcttcccaaagttctgggattacaggcgtgagccactgggcccagccttctagttttcttatctgtgaacagggaacactaatacccgtgttctctgcctcacaggatggttgtgtgggctaagttaatagatggtaatgtgtcaggcattgtatgccatatacttccacataagtcatcttatttaatcctcataactgccctgggaggcacatggtcttattctcattttatagatgaggaaactgaaatccttcaagattgcagtgtgttcaaatggcaggcaagtgcagagccaggatccaaatccaggtctcctaattcaaactgcacttactctacaattgtttctctatttcttaaactctgaaatgtcaggaaaatgatttcctggccattggtcataggaggtaggtgagaagacagtcgaagatggctgtccactgactgcttcctccctcactagggacatggcttctcagagactgatttgggttaggaaacaggagagctgcatgtctaaaatatttccttatgtggaaacattaagcatgtggatattttgcttcattatttaagtgtaatatatttaaccactctcggccgggcgcggtggctcacgcctgtaatcccagcactttgggaggccgaggcgggcggatcacgaggtcaggagatggagaccatcctggctcacacagtgaaaccccatttctactaaaaatacaaaaaaaaaaattagccgggcatggtggcaggcacctgtagtcccagctactcgggaggctgaggcgggagaatggcatgaacgcaggaggcagagcttgcagtgagccaagagcatgccactgcactccagcctgggcgacagagcgagactcgtctcaaaaaaaataaattttttatacatatatatattctatatttatatttatatatattttatatgtaaatataaatatatacatattttatgtaaatataaatatatacatatttttatgtaaatataaatatatacatatttttatgtaaatataaatatatacaaattgtgtgtaaatataaatatatacatatttttatatgtaaatataaatatatacatatttttatgtgtaaatataaatatatacatatatttaaccactctcctgttggcaggcatttatgttttcctggtcttttactagtccacagcatgtgtcatgactgagggctctcagcaatgctggagggatgtccttggctaggggagaaggactgggatctagtgtagcagtggaggaactgtctgtactggtgtcacaggtgctctggcatgtatcaggaggaaagaagcagatagggcctggatgctagggggtgggcacatgttatggtgggagcttgtggactttctttcatgatttcctctattttcttactaaaatagaaaataaggtcattgctaaaatggtgaaagggaaaaccaatttttttgttttgagacaaagtcttactgtgtcacccaggctggtgtgcagtggtttgatcacggctcactgcagtgttgacctcctggactcaggtgatcctcccacctcagcctcctaaatagctgagactacaggcacacaccaccatgctcagctaaatttttttgtatttctgtagtgacagggttttgccatattgcccaggctgatctccaactcctgggctcaagcgatccactcacctcagcctcccaaagtgttgtaggtgtgagccactgcacccagctgggaaaatcattttgatggctgaactgacaaaagggaattattgtctagaagaatgggaaagtgagtagactacggagatgtagttgattgctgagcgctcaagatcagagatcatgaaattaaaagaccagttgatagggttgtatgtttctccagctgttttcagccatgtgagtactggtgtaattggagatttggatttagccagtactggggtttagccaagtgagttttgttcctctttgcacataaattggcttatttaaggtttagtgtcagtgatcatgaacagtaaaatttcttggcaagagaatataaatgttgcagatttagacctgagacagtggagacttgacagaataaatgcttgctcttgctgtgctaaaaggaaccctcttgtggctttcagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgagtcagtacctgtgggcctctgagccacactgcactccattctgagtgtttggtttggaaacatgaacctgggaacgggaattagggtcacagtaaatgtggcatgcagaacatgttctcagatctatgatgaggtcaacaaagaaactgggctgggcatgaggggttgatgtagaggaactgccagaggttattagcccctgcgtgttccagattctggaccaggcatttagcctgaccagcttgtttcattttgccccagacttctggttttagcacagagagtcccaagtcccaggaaaatggagtcccaagtccctcagtaaatggagatggtggtcacctcatttctctctgggtatctgggcaactggtaatgctattaactggcacttagaatgcaggaaaaggaatgataaatgggctgtgttctgggcactctcagtctagtgcggatgtgcaggtggaactacaagtttaaagatgaaaagatctgtaaagccgttagggaagccgtgggatgggatgaggacatcagggacagcacaagaatgggaattggccttgagacaggacctcacagctgtcagtgcttgagaggcaggagaagaagagggccaaagacagaagctggggaaaagcagttaaaagtacaggacagcgggcagcatcctgaaggcaaaggaggaggaaatgacacagaagcagaggggttcagaaagggccagggctcatcttcactgtttctaacctgaattttgctcagggagaaaattgtttagcttgtcttcctttctcacccccgtgtatccggagagcaagagccatgtcttatcaacctggaatcctcattgcctaagacccagagcccagcacatcctgggcatttgggggatgtttgtgaaattagcatgctgccattctccttgtgccttgcttatacatccactcagcaagtatttgtggcacaactacttttccaggatcttgggatgcttcagggacctcaataatgaaaatctttgcccttttgaagtttattatctagcaaaacagacaggcatcaagacatttctatatgtgtgatgtaaattaaagaatatgttagaagatgattacatacgtcaagcagagtactggggtaggggagtgccaggcacattgcattttaaatagggtgttcaggccaggcgtggtggctcacacctgtaatcctagcactttgggaggccaagatgggaagatcgcgaggtcaggcgttcgagaccagcctggccaacatggcgaaaccccgtctctactaaaaatacaaaaattagctgggcacgatggtgggcacctgtaatcccagctactcaaaggctgaggcaggagaatcgtttgaacccagaaggcagagatggcggtgagtcaagatcataccattgcactccagcctgggtgacgggaagactccatctcaaaaaaaaaaatagggtgatcaggatggcttcattgaaaaggttagatatttgaggaaaaacctgaaggaggtaaagaatttagccttgtggctatctgagggaagagtattctgggcagaggaaacagccagtcctaagactgcaagacggaggaatgcctgatacattcaaggaagagcaacaaggccatcgtggccactgcagagtgagtaggggtgagaatggtgggagatcaggcctggcctacttttttgcctctgtaaggacttccttggctttcactctgggtgaaaagaggagccactgagagttctgagcagaggtatggcataatgacttccttatatcccgaacgtcaaggagcaagaatggaggtagggcctgaagggagcggtcacagtaactcaggcatgagttacttgggaggctgaggtgggaggattgcttgggccccaaaggttaaggctgcagtgacccgctccagcctggtcaacagagagagatcttgtctccggaaaaaaaaaaaaaaaaaaaaagttgcaataactgagttgagaaagactgcgagtagattttgcaggaagagcagaagttcagtttgaggtatatggagttgagatgtcaattaggtatccagatgatgtttagtagcagttttatattttaacctggtggtcagaagagatctctgagctgcacatttaatttgggagtttgggggcacatctgtacttcatctaaagcatacatcttttcctttttttttttttttggagacagaatttcactgtttttgcccaagctggagtgcagtggcgcaatctctgctcactgcgacctctgcctcccaggctcaagcaattctcctgcctgagcctcctgagtagcaccaccatgcccagctatttttgtatttttagtagagtcggggtttcaccatgttggccaggctggtctcgaactcctaacctcaggtgatccacctacctcggcctcccaaagtgctgggattaaaggcatgagccacagcacctggacctattttcaaatctataaaatcaggatgaatcttttttcttattttttgcctttttttctttcttttcctttttttctgtttttcaggatgaatcttaacaatagatgatgtatgagtttaattagcattttttttctttcaatggaccataaattatgatgcatcttacctttggtggattcttagatttgatgaaatatggtagatagtatgtaaagccatgtgactggatgagctcacaaagtgttaaaagtgttgatagagaagaaaaaaggaccatctattgagccctggggcaccccagagtttagaatttaggaagaaacagaaaatccagctgggcacggtgactcaacgcctgtaatcccagcactttgggaggccgaggtgggtggatcacttgaggccaggagtttgagaccagcctggccaacatggtgaaaccccatctctactaaaaatagaaaaaaagtagctaggcatggtggcacacgcctgtagtcccagctactcgggagggtaaggcaggagagtcacttgaacccgggtggcagaagttgcagtgagccaagaacacaccactggactccagcctgggcaacagagcaagactccatctcagaaaaaaaaaaaaagaaaggaagaaatagaaaagccaaaagaagagatggaaaagcgccagcgagtgtgagatgaagaaaatcaagtgcatggtattctgagagccaagcaaagaaagtctgtcaagatggaaagggtaatcagcagtgtcagatacttctgatgggtcataaaaaatgagggttgagaatttatcattggatttagcaacatggaggtaactggtgatctagacagggtcttctttatgacatggtgagggtgaaagctcatttgaaattggtttaagagagaattggacatagcaaacatagatagctcttttatggtatttgctacagagaggaacagagcaggggcaagggccagggtcagtaactagctggaggaagtaaggtcaagaaggtgttttttggatggaagaagtcacaggatatttttatactggtgggaatgttccagtagagagaaaaatggataatgtaggagagagcgaggaaaatggctggcgtgaaacacaagagtaagcaagagacaatgggaaagggggtttggtaagttgtcttagctctttttctttttttttgaagacaggtttcactcttgcccaggctggtctggaactcctgggctcaagcagtcctcccacgttggcctcccaaagtgttggattatagatgtgagccaccattcccagcctggccttcgcttttatttttattatgtcatatatatatagagagagagagagagagtttttttttttttttttttttttgagatacagtctcactctttacccaggctggagtgcagaggcacgatctcggctcactgcagcctccgcctctcaggttcaagtgatcctcctacctctcagcctccatagtagctgggactacaggcgtgcaccaccacacctggctaattgttgtatttttagtagagacggggtttcaccatattggtcaggctggtctcaaactcctgacttcaagtgatccacccgcctcagcctcccaaagtgttgagattacaggcatgagccaccacgcccagcccagtcttagcttttagacagaatcatggatcattcagttggtaccctgactggggctgctgcctttctttcagagatgccctgctcagaggggaggaatctagagaggcagtctggctacagtggttttgtggcgctgcagttggctccacccagttcagacttcccagcagctttgtttacgctgtaaagggaaaatcgcctactcaagcacagatgggaaacatgggtgcagactctggtggatgagaaaagttgttgattgaagattgtggaagttctcagggcttcagtccttttgatgaaataggaaacaagatcatcagttaaaaattaccaaagaagccggacatgatggctcacgcctgtaatcccagcactttgggaggccgaagcgagcggatcacgaggtcaggagtttgagaccagcctggccagtatggtgaaaccctgtctctactaaaaacacaaaaatcagccgagcttggtggtgcgcgcctgtagtcccagctactcgggaggctgaggcagaagaatctcttgaacctgggaagcagaggttgcagtgagccgagatcgcgccactgcattccagcctgggcgacaggcagagcgagactccatctcaaaaaaaaaaaattgccaaagagatagtggagatttaggagagaaggcatatattaggcctctaggggagtgggagagggagtagacaaggtttctgtagaaggatttgccagtcccacgggaggttagaggttttggatctaactacaaaccagtagagtggtatgttttcctccaaacttgtttagctgtgtagctgccggcagagtgggcccagacatggatttaactattgtgattttgtcaagcaagtagtataaagaggaaggggcaatatcttttgtaaatgcccaggaattacttagttgcatgttttagtataaacagtaactgctataattgtggttttaattagcttattttgtaaaaccttatacatcatatccaaaagctctgttgtacgtttttgtttttttgttttgttttttatttttttgagatggagtcttgctctgtcacccaggctggagtgcagtggcgccatctcgactcactgcaagctccgcctcccgggttcacgccattcgtcggcctcagcctccccagtagctgggacaacaggcgcctgccaccacatccagctaatgttttgtatttttagtagagacagggtttcactgtgttagccaggatggtctcgatctcctgacctcgttatctgcccgcctcggcctcccaaagtgctgggattacaggcgtcagccaccgagcccggccccaacttaagttttacagacattgaacccccactttctgccaagagcctgcaaatactaccacatttactgtttacaacaattctgaaaagtagagaatagctccatagttaacttctaagaagctgaggcttgggacaatttgctctaagttaaacagctactaatcaagccctgactaacaattgtctttagctcccctctcatctccccttccttcaatattaataacaactaacatttatgtactttgcattatcatgtaacaaccacagtgaggctgttatctccattttacatctgaggacgctgaggcacagagaaattaagtgatttgcttgaaatcacacaactagttttcattgggacctgaatttgaagccaggcaattttaactctgaatcttggaagaaattatctgaaaatgtgttactgtaggaggtgagggtgcttttaagaaacagcaggaccaaagccttcagagctaccagggcgtgacatctgcatcaccccttccacaggtaacagcctggtcacaaatcctgtagctcctggctgcatgtttggctcttaacttgcttggttttgagctctggtgttctcttcctcctctgcagctcagggcttttcttagaataaaaaaagatacatctgaccactccgctagccagttgcagtctgaccagcttctgctgttttggcctaattctcccctgatatgtttaaaccagatcattatgataattcttcagtgttaaatgaaggattaattggaactgcctactgtcttagtgtcagcagagtcaaatagtggatgtttcagagacttagacaactcttgtatttgtcttacataccacagcagaggccagtagttactggcttctggtgtctatatggtaagctcagatattttcatttgctagtaacatctttcaatagtttatcttttctgagttaaaattcagttaggctttaaatatttatgtcaactacagggtgttgctctgaagtaatttcatttgtccattgggtgtttatcaatgcctgtggagtatgaggtagaggcagatggtgtggagtccctgcccttagagttcatggtctgatgggctggggcttgaaacatggagtggtgaaaacgcagtgccagaggtcaggccattcccgaaagatctagttcagcgccatttcacagatttatatttagcttttgcatctgttcttcccttggttttaagatgagtttctccagtcccttacccggttcccatcaagccatgttggctaatggtaggaggataattagggcaggtggtgagcagagtggaggaagggaagacttaatgggacaaagcctttgctccagcacagtcagctctctctggggacagaaagcggaaataaattcacagctgggatagctgaggctaggactcagcagcaggattctttgtgagcaggtagtaagaattttagtttaaaactgcccctaatcacttttgattttggggcagaccaaagtaaagattctggttggcagagattggctacgtctgagttctgatcttgcctttgtcccatcttaaccatatgatttggggaagctactgtttatcattcctgtacctcagtttcttctataagagattatccgactttccacagttgtattgaggattaaataagtttaagtgcctaacacagggttggcataatacatggcatatagcaggtgcttgataaaagttatttctcttccctctgtggagatctgctgctcagtgctaggaaagattctccccaagcacctggaaatagtggaggaggtgacagcagtgagctcatttaatcgtctttctgcagtcacagacctcactcatagaaaaaagctgccatgatctttgtccactcattggcatttggttttctagcttaactttgaagggctacaaatatatgtacaatttaaactggatgacaatattttactttgcctcttccccagaaaagtttagccagcttaaaaaattgcatacaatgcaaaaggataacatgaatgtttgagagaatgaaggcaaaggagaagccacaatagaaaaataatgcaggggtaagatgagctcagctctgtaggctcgctcctaacactgatcctctgctggagtcactctggctggcctgctattctgtgaaaatgccgggcacccttctgcctgttcttgctcttgcctctgccagggacacttttgaagataactgcgtgacttcccgcctccctcactcagggctcttctgacaagccacactccctgcctctgccccttccctgtctctttctcctctgatttgtcttttttttttttttttttaagacagagtttcgctcttgttgcccaggctggagtgcaacggcacgatctccgctcaccacaacctccgcctcctgggttcaagcaattctcctgcctcagcctcccgagtagctgggattacaggcatgcaccaccatacctggctaattttgtatttttagtagagacggggtttctccatgttagtcagactggtcttgaactcccaaccccaggtgatccgcctgcctcggcatcccaaagtgctgggattacaggcgtgagccactgcgcccagcctatttgtcttcttaatatttatcagttcctgacatcttttttttttctttttctgagacagagtcttgctctgtctcccaggctagagtgcagtggtgcagtctcggttcactgcaacctccgcctcccgggttcaagcaattctcctgcctcatcctcctgagtagctgggattacaggcacgcgccaccacgcccagctaatttttgtatttttaatagagacggggtttcaccatgttggccaggctggcctccaactcctgacctcaggtgatccacccacctcagcctcccaaagtgctgggattacaggcatgagcccctgcactcggccagttcctgacatcttactagtttttttgtttagtgtgtgcctcccctccccctacaatgtaagttccgtgatggcctgccttggcatcttcttttactgttgctgtactcctcatgtgtagaactgcctggtacatagtggatattcagtaattatttgttgagtgagcacgcagaagtgcatatcatacagatctgtttacttgccagaaacagatttcagatttgactcctatctcttaatggtgaaaagaaataaaaaaaacacaggagttgcaagattcactgtgtccatcaggcaaaacaaaaagcttatttaggagaaacctgatatgaaacttgaaagaaatgtttcttttcagttctcaatgagtaataatgtatgatacggtagagaagattcctgaaaggatcattacattatttataacaacacattttgtctctttttaatttggactttattgtattcatagctttaactttttaaaagtcaaaattggccgggcttggtggctcacgcctgtcaatcccagcactttgggaggctgaggtgggtggatcacctgaggttgggagttcgagaccagcctgaccaacatagagaacccccgtctctactaaaaatacaaaattagccgggcatggtggcgcatgcctgtaatcccagctactcgggaggctgaggcaggagaattgcttgaacccggaaggcggaggttgcggtgagccgagatcatgccattgtcctccagcctgggccacaagagcgaaactccgtctcaaaaaaaaaaggtcaaaattatttatctttcaaatcatgtattaactattatttgtaatccactatgattaagacagaatttggggctgggcacagtggctcacacctgtaatcccagcactttggaaggctgaggcgggtggatcacgaggtcaggagttcgagaccagcctgtccaacatggtgaaaccccatctctactaaaaatacaaaaatttgctaggcatggtggcacgcgtttgtagtcctagctactcgggaggttgaggcaggagcatcgcttgaacccgggaggcagaggttgcagtgagctgagattgcaccactgcactccagcctgggcgacagagtgagactctgtctcaaaaaaataaataaataaaagagaatttggctgccttaggtgagcagttaataccaatcaaaagaaaatttaagattgaagtagctgtaaagaatgatgaagaccctcattcccaggaaatcaatttccatctttggacaaatctcaataccagaaactgatttaaaaagaaaaggttgggtgcggtggctcatgcatgtaatcccatcactttgggaagctgaaacaggaggacctcttgaggccaggggttcgagaccagcctgggcaacatagtgagcccttgtccctactaaaatttttttttaaaaattagcaaggcatggtggtgcacactcgctcgtagtcctggctactcaggaggctgaggtaggatgattgctagctagagtccaggagttcaggattaaaatgagctatgatcataccactgcactccagcctgggtgacagagtcaaaatttatctcaaagtaagtgtttagattgtggtttttgtgcataaatgaaaaaaaaaaatagaagaagaagaaaaaagataaagcacataatactttaaacatattgatgcatatgagtgatatgggaagaataaattcaaatttcaaagttggaattaatataggtattattattttggaaggggaaatctcaaacctttacactaaatcaaagaaaaaaattcagaatttcaaccagtcaccaaagaaagtgaaacactgcatatctacatgagtatctgaaacagacagaaactagactaacttccatgaaattaaattccattaaaatatttcattgaaatccccttgaaatacgttaacatattctgatctaaaatgaaaaaagatttaactatgtaatctatgtaagttagaatgcatattctatttagagagttgattaagtaacattgatattattttatgaggtgttttttttttttaacttttaagttcaggggtacaagtacagatttgttacctaggtaaacttgtgtcatgggggtttgttgtacagattatttcatcacgcatgtgttaagcctagtatccattagttatttttcccgatcctctccctcctcccaacctccaaccttctataggccccagtgtgtattctcccctatgtgtctgtgtgctctcatcatttagctcccacttataaggacatgtagtaggctgggtgcggtggctcatgcctgtaatctcagcactttgggagactgaggcgggtggatcacgaggtcaggagttcaagaccagcctgaccaacatggtgaaacccatctctactaaaaatacaaaaattagctgggtgtggtggcgcgtgcctgtaatcccagctacttgggaggcttaggcaggagaatcacttgaacctggcaggcagaggttgcagtgagccgagatcgcgccactgcactccagactaggtgacagagcaagactctgtctccaaaaaaaagagagagagagaaaaaaaaaaaaaggacatgtggtatttggttttctcttcctgtattagtttgctaaggataatggcctctagcgccatccaagtccttggcaaaggacatgatctcattctttttttttgagacagaatttttgctctcttgcccaggctggagtgcaatcgcacgatctctgctcactgtaacctccgcctctttggttcaagcgattttcctgcctcagcctcagcctcctgagtagctgggattataggcgccagccaccacacccggctaatttttgtatttttagtggagacaaggtttcactatgttggccaggctggtttcgaactcttgacctcaggtgatccacccacctcggcctcccaaagtgctaagattataggggtgagccactgcgcccagccaatctcattcttttttatggctgcgtagtattcatggtatgtaccacattttctttatccagtctatcattgatgggcatttgggttgattccatgtctttgctattgtgaatagtgctgcagtgaacatatgcatgcatgtgtctttataatagaatgatttatattcctttgggtgtatacccagtaatgggattgctgggtccagtggtatttctaaaaatagtactgaaccactgtatttcatggagaacaacacagtgtggtcagttagacgtgctgagctatagtgtcttgatccctgcttttttgtttgattatgaacacagggctcacgagcagctaaatgtgaaacatgaaccactccagctcatccagcctcagtttgagacgccgctgccaacccttcagcctgcggtgagtaggtgtgcttgggagatcccactgcagagccccactgttgcccttatcttgtcagcaggcattcgctgtggtcccttccatgtgccatttgtggcactccttgtggagtcatagtgctctgtctctaaacatgcatggacaccaaatttgttaatgttctatagagacttccatgtggtatgcttccaaattgaggaatcaaggatgtggagccttctggctattaaacatttcctattctcatcttgtggggttggagggcatatatgagatttcttggataaaaaggaagaaaactttgtactgccattccaggtgtcagggcctgattcataacataattctcacagcccaggggatagttatggtcatgtgtgtaaataggttatttttcaacatttcagtccaacattcaacttgcctttaaaattaccttgtctcaccacattctgaaatgttatgagccagttagcttgatcttgcttggtagcttgaaattggccatggtgagaggatttacattacagaaaatggtaaatgctacaaaacaggccttcagttttgttttgttttgaaagtagttaaacatttacccgcataccattggttcatacctacaaaatgtgactccaggttcaatactttctacactaatctgcatctggttctccaaataacttccatccctaaaaacttatgattaaatgagaaacaagttgtacaatcaaatgttcaacacaaacctaagccccaagctttgtgtcatcgttctgagttaattagcattggtatgtcagcttggtcagtttagtggtaattagagctggttctacttggttgtttacagtgggctaataatctttcttggtatgggtctaatgggtgagggtagacgaggtgatgggagtttgggtatttcatcctcagggaagagccgagttactgttctgtaggggtttccatgtggtgtggttcccaactgaggaattaaggatgtgaacttccttattctccttgtgtcttatcactgttagttatgattttggacaagctctttcttgagagactttatttcctttaccttatcctccctcatttctaaataatgactttatttccttttaggtttttcctcccagtttccgggagttaccacctcctcctctggagctatttgatttagatgaaacgttctcctctgagaaggcacggctggctcagattaccaataagtgtaagtttggcgaactttttttttttgagacagagtttcactcttgttgcccaggctggagtgcaatggtgcgatctcggctcactgcaacctctgtctcccaggttcaagcgattctcctgtctcagcctcccgagtagctgggattacaggcatgcgccaccacgcccagctaatttttgtatttttagtagagacggggtttcatcatattggtcaggctggtctcaaactcctgacctcaggcgatcagcccgcctcggcctcccagagtgctgggattacaggcgtgagccaccatgcctggcctaagtttggccaacttttaaactttgttttctcttatgagttttatttaatcatgaatttctgagaattgctatgagagactgcttagagtttgtttagggaaaacaaaatatgaataggagtataaacttaccattcttatttatgtcatgtaaataatgttggttgttcttctcgaggctatttagttcagtgaattagaacatagtgccaagcagaaagccaaaggtctcagctttgatccctgtgagtccttagttctgacctattgagagaccatagaattaatcttgaccctggctgccacttagcaaatctcagtcagtggtcataggagcagctaaataaggaaattgagtaaggcccaaagaatgatagagacttcaaattggacaggatctgagagagagccaagtgtgcccaccttgacatgtggatgaagaaatgaggccccaggccacacagctccacggtgagtggtcctcctgacttttggtctggggctgctcctgacatgaattgcctccaacacagcaaatgggtctgcacatatatgctcagaggcataaaattaaccatccactttgaggcagtgaccccactcctggaactctaatctaaggagattatattttttttttttttgagacaaagtttcactcttgtcgcccagccttgggtgcaatagtgctatctcagctcgaggtaacctccgcctcctgagttcaagcgattctcctgcctcagcctcccaagtagctgggattacagttgcccaccgccacgcatggctaatttttgtgtttttagtagagatggggttttaccatgttggccaagctggtctaaaactccagacctcaggtgatccacccgcctcagcctcccaaagtgctgggattacaggcatgagccaccacgtccggccaacttctacactatttatttttaaaatacaataaactcgggaggctgaggtaggaggatcgcttgaacttaggaatttaagaccagtctgggcaacatagcaagaccctgtctctaaaaatatattttaaaaaaataacaatttttaaaaatagaaaaaaactataaatttgggaatagctttaatgtccactagcagagtaatggtcttaaaatgcgtcacattcatttggtaggagaatatgtagtcattataaaagaggttcacaaaggctagggaatgacacatatgacacagacagaatttaagagagaatcctgaatgaagaaagcaagatataaaactgcatgtacaagaggataccagctatgtcagtaacatctgtatgtgcccaaagcccagaaagaagtaagcaaaatggaaacagttcagtgtaaacgaagacctttactgcatctctcttctgtggcaggcattgctgtgggtcctgggcagtcaaaaatgagcaggacatagtgatgagtccaggaggaatcacagaacggtgaagaagcagctttgacttggcatttctgtttctagcaactgtcctatggaaatccttgtagaaatgcaagacaaaaaagatatagatattaattatagcattcaaaaaattggaaacagtctaatggtccatccatcattagggggattggttaaaaagagtatgaaataagcctgggtcacatagaccccatctctacaaaaaaaaaaaaaaaaattgcctgagcacggtggatcatgcctataatctgaacacttcaaaaagccaaggcaggaggatcagttgaggctgggatttcaagaccagcttggacaacataatgagaccttgtctcaaaaaaacaaaaaaaaaggctgggtgcagtggctcacgcctgtaatcccggcacattgggaggccaaggtgggcagatcacctgaggttgggagttcaagaccagcctgaccaacatggagaaaccccttctctactaaaaatacaaaattagctgggtgtggtggcgcatgcctgtaatcccagctactggggaggctgaggcaggagaatcgcttgaacccaggagttggaagttgcggtgagccgagatcgtgtcattgcactccagcctgggcaacaagagcgaaactccatctaaaaaaaaaaatttttttaagtagccaggtgcggtgacgcatttctatattcctagctacttggaaggctgaggtgggaggatcacttgggcccaagagttggaggctgcagtgagctatgatacaccttgcactccagcctgggtgacaaaggaccctgtttctgaaaaataaataaatagaaacaaaatagaatattacatacctgttaaaagaaaaatgtagcctgggtgcgatggctcacacctataatcccagcactttaggaggctgaggcaagaggatcacttgagaccagcctgggcaacactgtgagacctcttctctatagaagaataaacaaaattagccgggcatggtggctcactcctgtagtaccagctactcaggaggcccaggtgggaggattgcttgagcctaggaagtcaaggctgcagtgagctaagattgtgccactgtcctctaacctggttgacagagcgagaccctgtctcagaaaagaaaaggccaggcgcagtggctcatgcctgtaatcccagcactttgggaggccgaggcaggtggatcacaaggtcaggagtttgagaccagcctggccaagatggtaaaaccctgtctctactaaaaataaaaataaaaaattagccaggcatggtggcaggtgcctgtaatcccagctgcttgggaggctgaggcaggagaattgcttgaattcgggaggtggaggttgcagtaagccaagatcacgccactgtactccagtctgggtgacagagtgggactccatctgaaaaaacaaaaaagaaaataaaaaaaatgcagggcataaactttgattcggaatgtccataatacatcattaaatgatgaagtcaacttagaaaactattctagtttgatcccatttttgtgaaaacttacatttacacacagaagcatacatagcaataataattctaggtagttggtggcagtagaactaggatgaaacattgatacagctgtgggtttgaatgtcttagtaaaaaacatacatttctatcaaaacttaaaatgcaaatcagagggagaataaattaattacagctgggctcagtggctcatgcctataagcccagcactttgggaggccaaagcaggtggattgctggagctcacgagttcgagaccagcttgggcgacatggtgaaaccccgtctcaaatacaaaaaatcagccaggcgtggtggtacacacctgtagtccaagctacttgggaggctgaggtgggaggatggtttgagcccaggaggcagaagttgcagtgagctgaaatcatgccactgcactccagcctgggtgatagagccaaaccttgtctcaaaaaaaaaaaaaaaaaaaaaaaaggaagaaagaaattacagtataatgtgagaagggcagtaatggctgtctatcctacatgtagggctccagaggatggcttcacagagctatgttgttggtggaattatgggtgatttttttctttaattttctttctataatattgtttgttttttggggttttgttttgttttgttttgttttgagacctaattttgctcttgttgcccaggctggagtgcagtggcacgatcttggctcaccacagcctcagctcactgcaacctctgcctcccgggttcaagcgattctcctgcctcagccttcctgagtagctgggattataggcatgcaccaccacgcccggctaattttgtatttttagtagagatagggtttctccatgttggtcaggctggtctcgaactcccggcctcagatgatccacctgcctcagcctcccaaagtgctgggattacagatgtgagccaccacgtcccccaggctggagtgcaatggcgtgatctcagctcactgcaacctccgcctcccagggttaagcaattctcctacctcagcctcccgagtagctgggattacaggtgcgcaccaccatgcccggctaatttttttgtatttttagtagagacagggtttcaccatgctggccaggctggtctcgaactcctgacctcgtgatccgctcaccttggcctcccaaagtgctgggattacaggcgtgagccttcacgctcggctgttttgttttgttttgtttgagatggagtctgttctgttgcccggggtggagtgcagtggcgcaatctctgttcactgcaacctccatctccccagttgaggtgattctcctgcctcagcctcccgagtagctgggattacaggcctgcatcaccacatctggctaatttttgtatttttagtagagatggggttttgccatgttggccaggctgatcttgaacacctgacctcaagtgatctacctgcttcagccttccaaattgctgggattacaggcatgagccaccacgcccagccaatacaatattgttttagtaaatgctatttttaattacccatatgcttctctatagtcatctttgttgcattcagggaatgataatttgatttcctactgttgcacctgttctttctaatgtaggaatactagatctgaggaataggaaagccagtaccagtccagttttattctgattaggagtgcttttattataaaagcagcacattagagagctctagggtttttcagtgttgaaatcctgtagtcacattactttaggaagaggtgagtgatcttaggaaatgtggaaacatgacagggcatacctgaaacacactaagtctgtactttgggaagggcagaagttaagaattaatctaactactactccaactgtcttaggtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggtacagagcctacaaggcacagtgtagtgggagcccctccagtactggtatcttccatggactgtgcttgccatgttttatgacgttgattcagcctgtaaatatttattaagcatctactaggtgaacaaaacagacaataaaccctgtacttatggaacctatatactagctggaggatgtagacaataagcagtaaacataagtgagtcacataggatgctagaaaatggtaagtgctttggtataaaagaagtggaggctgggcgcagtggctcacgcctgtaatcccaacactttgggaggctgaggtaggcagatcacccgaggtcaggagttcgagaccagcctgaccaacatggtgaaaccccctctccactaaaaatacaaaaattagccgggcatcatggtgcgtgcctgtaatcccagccactcaggaggctgaggcagatgaatcacttgaacccagaaggcagaggttgtggtgagctgagatcgtgccgttgcactccagcctgggcaacagtgagactctgtctcaaaaaaaaacaaaaaaacaaaacaaaacaaaaaaaaaacagctgggtgtggtggctcacacctgtaatcccagcactttgggaggccgaggcaggtggttcagctgaggtcaggagtttgagaccagcctggcgaacatggtgaaactccatctctactaaaaatataaaaattaaccaggtgtggtggtgcacgcctgtaatcccagctactagggaggccgaggcaggggaatctcttgaacccaggaggcggaggttgcagtgagccaagatggcaccactgtactccagcctgggtaagagagtgagactctgtctcaaaaaaaaaacaaaaaaatagagctgggtaagagggatcaagtgtgctgagtgtggccatgatgactggtgagtattaaatagggagatcagggtgggtttcattgcaaagttgtattggagcaaagatttgaaggtgttgagagacttagccatgcagatatctgggggaggagtgtcccaggcagaggggagatgtgtgcaaagttcctaaggctgggctgtgcctggtatgcttgacgaacggcagtgatgccagtgtgacaagagaacagaggaaaggacagagcagtagaacatgaggtgatcaccttatgtaagaaatgattttctcaggccgggcaccgtggcccacacctgtaatcccagcaattgggagcccaaggcgggcagatcacaaagtcaagagattgagaccatcctggccaacatggtgaaaccccatctctactaaaaatacaaaaattagctgggcgtggtggtgcatgcctgtagtcccagctcccatactcgggaggctgagacaggagaattgcttgaacctgggaggcggaggttacagtaagccaagaccacaccactgcagtccatccagcctggcgacagagcaagactctgtctcaaaaaaaaaagaaaaagaaatcatctttctctgactgaggaccaagaacttcaaaattatccctggccttcttttttccaaggatttcaaaaattgaatgcccaaccagctttggtaaataggcattcatacactactgatggagaataagttggttccacttgtctggagatatttttataatactgttgaaaagccctaaaatgtatataccgttgacccattctaatcttcagaatttgttttaataatataattcggaatacgtacagatttatcaaccaggattctcagtgccacattattttatagaagaaaaatcttcatcaatagggaactggttaagtatcctagggtacatccataagataaaaaatgtttttaaaaatgtttggccaggaatggtggctcacgcctgtaatcccagcactttgggaggctgaggcgggtggatcacgaggtcaggagttcaagactagcctgaccaacatggtgaaccctcctctctactaaaaatacaaaaattagccaggtgtggtggcgtgcacctgtagtccctgctactcaggaggctgaggcaggagaattgcttgaacccgggagacagaggttggcagtgagccaagaacgtgccattgcactccagcctgggagacagagtgagactctatctcaaaaaaataaataaaaaataaaaataaaaatgtttaaggacttgggccaggcgctgtggctcacatctgtaatcccaacactttgggaggctgaggtgggcggatcacttgaggtcaggaattcgagaccagcctggccaacatggtgaaaccccatctctactaaaaataaaaaaatcagctgggtgtggtggcccgtgcctgtagtcccagttactcaggaggctgaggcaagagattcgcttgaacctgggaggcggaggttgcagtgagccaagattgcaccactgtactccaacctgggcaacagagtaagactcaaaaaaaaaaaagtttaaggacttgggaatacattcgtgatacagtaaatatgtggtggggagagactaaagaacagtatatagagagattctactttctttacagaatacaatacacacatagaattattttgcataataaaaaaataacataaagatatttatccttggggcccagtgcggtggctcacgcctgtaattaatcccagcactttgggaggccaaggcaggtggatcacgaggtcaggagatcgagaccatactggctaacacagtgaaaccccgtctctactaaaaatacaaaaaattagccggccgtgttggcgggtgcccatagtcccagctactcaggaggctgaggcaggagaatggtgtgaacccgggaggcagagcttgcagtgagctgagatcatgccactgcactccagcctgggtgacagagtaagactctgtcccccccaaaaaaagaagatatttatccttgggctgggcacagtggctcacgcttgcaatcccagcactttggggggccaaggtaggtgaatcatttaagcccaggagttctagtccagcctgggcaacagaaactccacatccataaaaaaatacaaaaattagccaggtgtggtggtgtgcacctgtagtcccagctacttgggaggctgaggtgggaggatcatctgagcctggggaggttgaggttgcagtgagcagtgatcatgccactgcactccatccagggtgatagagtgagaccctgtttaaaaaaaaaaaaaaaagatagtgtttaatttttattttccttctttattaaaatttctatagtgggccgggcgcggtggctcacgcctgtaatcccagcactttgggaggccgaggcaggaggatcatgaggtcaggagatcgagaccatcctggctaacatgtgaaaccccgtctccactacaaatacaaaaaaaaattagccgcgcgtggtggcgggcacctgtagtcccagctactcgggaggctggggcaggagaatggcatgaacctgggaggcagagcttgcagtgagccgagatcacgccactgcactccagcctgggtgacagagcgagactcgtctcaaaaaaaaaaaaaaaattctatagtgactgtgtcacttttgcagcaaaaaaagagtgttttgttgtttaatgtaagcaggcaaaattcaagcttaggatttcagatgctgagtggaaagaccaattaggttctgagcctctcctggaaggaagctggctgtgccggatgctcatttggcagtgttttactctccacgtctagcatggtgctggaggctggggccatagcagtgaacaagatgattgcggttcttgctgtgcctctcagagctctgtgtagtgggagacagaagtgtattggcagttaccgtggtctaagtgccatccatgaagggaacccagagatgagggttttgatgtggctgctcagcagtgaatgatgggatgggaggtcaggtaggttcccagcagtactcactctggtggcatgctaggacagacacccgaggccaatataagaagtctggtgtggtctttgcaccagtgctttcaactctgtttgttactcatcatggtgggtggtgggcagtggtcacaagccctgccatggtagggcaaaaggatcaaaatttgatccttgggttggattcagccctaaagccagatattatgtatatgtcctaattaataaagattcagaatctctaaagtccaaagcactgaagagtttacatttcaggctttatactgaaatactaaaattctgtgtcttattctctcatccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctatgaaacagtcttgatttttttttctcaaccccagttctggatttgagtcttttatcaaagacataattaactctcaagcttgttgtaaatactgtacagctttctggaccggttgaaaggatacaacagtggctggacacggtggctcactcatgtaatcccagcactttgggaggccgaggcgggcggatcatttgaggtcaggagttcaagaccagcctggccaacatggtgaaacctgtctctactaaaaatacaaaagttagccaggtgtggtggcatgtgcctgtaatcccagctacttgggaggctgagacaggagaatcacttgaatctgggaggcagaggttgcagtgagccgagatcacgccactacactcccgcctgggtgacagtgagactctgtctcaaaaaaaaaagggggggatgggaggctaggtgcagtggctcatgcctgtaatcccagcactttgggagaccgagttgggtggatcacgagggcaggagatcgagaccatcctggctaacatggtgaaaccccatctctactaaaagtacaaaaaattagccgggcatggtggcacacacctgtagttccagctactcgggagggtgaggcaggagaatcacttgaacccgggaggcggaggttgcagtaaactgagatcacaccaccacataccagtctgggtgtcagagcaagactcttgtctcaaaaaaaaaaaaaaaaaaggatacagaacttaacccatagtctgtttaccccactgtacctaaagaagaagataaaagagtagacagataccttccttatatagatctcatcccttcatctcccagttgcccataggacacaaccatgtagagcaagcttgtccaacccgcagcccatgggctgcatgtggcttaggacggctttgaatgtggcctaaaacaaatttgtaaactttttttttttttttggagacggagtctcgctctgtcacccacgctggagtgcagtggcgcgatctcggctcactgcaagctctgcctcctgggttcacaccattctcctgcctcagcctctccgagtagctgggactacaggcgcccgccaccacgcccggctaatttttagtatttttagtagagatggggtttcaccgtggtctcgatctcctgacctcatgatccgcccgcctcagcctcccaaagtgctgggattacaagcgtgagccaccgcgcccggcctacaaatttgtaaactcttaaaacattatgaggccaggtgcagtggctcatgcttgtaatcccaacactttgggaggccaaggtgggtggatcacctgaggccaggagatagagaccaacctggccaacaggatgaaaccctgtccctacaaaaaatacaaaaattagccaggtgtagaggcctggtacggtggctcatgcctgtaatcccagttctttgggaggccgaggtggatggatcacttgaagtcaggagttcaagacaagcctggccaacatggcgaaaacctgtctctcctaaaaatacaaaaattacccgggtgtggtggtgcaggcctataatcccagcttctcaggaggctggggcaggacagtcgcttgaaccccagaggcagaggttgtggtgagctgaggttgtaccactgcactccagcctgggcaacagagcaagactgtctcaaaaaaaaaaaaaaaattagccagacatggtcaggcatagtggctcatagctgtagtcccagctacttgggaggctgaggtggggaaaatcattgaacctgggaggcagaagttgcagtgagccaagatcacataactgcactccagcctgggtgacagagcaagactgtcaaaaaaaaaaaaaaaaattaagagatagatgtgtttattattatttttatttttattttttttattttttttaagaaggagtctcgcccttttgcccaggctggagtgcagtggcgctatcttggctcactgcaaactccacctcccaggttcatgccattctcctgcctcagcctcccaagtagctgggactacaggcacccaccaccatgcctggctaattttttgtatttttaatagagacgaggtttcactgtgttaggcaggatggtctcgatctcctgacctcatgatccaccagcctcggcctcccaaagtgctgggattacaggtgtgagccactgcacccggccattattattatttttttagctcatcagccattgttagtgtattttgtgtgacccaagacaattcttccaatgttgcccagggaagccaaaagattagatactcctgatttagaagctgagcctggggaacaaaagtgaaagtccatctctacaaaaatgaaaattagccaggtatagtggcacacacctgtagtcccaggtatttgggagactgaggtggcaggattgcttgagcccaggagttcaaagctgcactagctatgatcataccactgcactccagaatgggccacccatgcttcttccctgtcctctggcttcctgaagcactcagttctatcatcatcttgggttataatgtagggccaaatttaatcatctgttccaaggaggctagagggtattgtcatgggacaatgggagagactgcacctgtcagaatggtgcagttggtgtatagaaatgcacagcagtgtactgacatacacagataaccagctttggggaactctgaaagccagatggaaggttgcagagccactgaggataggagaggagagaagggagaggagaggagaggaggggaggggaggggaggtgggaggaaaggggggaggggggaggggaggagcaattcccattgctgcacaatgggaatagtttagctggtgggttctataaagatgggaatggtagaaggatggtcatttacagaagagtttgatacaaccccaagagcaaataataaggatgtggactaaggtggtattataggaaaggtggcattttgaaacactttggtctgggtgttgaaagttagattggcaagatttggggcttgatttcctgggacagtgggggcagctattaaaagatggggagtctaggccaggcacggtggctcatgcctgtaatcccagcaatttgggaggccgagacgggcagatcacctgagatcaagagttctagaccagcctggccaacatggtgaaaccccgtctctactaaaaatacaaaaattagcctggcgtggcgggcgcctgtaatcccagctactcaggagactgaggtgggaaaattgcttgaacccgggaagtggaggtagcagtgagtcgagatcatgccattgcactccagcctgggtaacgagggaaactctattaaaaaaaaaaagatggggagtctgaaggatgagtggttttggagcataagagtccagttgagactatggcaattaatacaggtggaaataactagtaaatggctggaaatccctaatttaggcttagaaaagatgtccagtctcaagagtggagttgttcatatggagtggttaattaaagtcatgagaatcatttgtcaaagagtagtgttagaaatttaaaagcttgggaagaacagctcaagtcaaatcctgagtttcaaatgatttcttcatggtaaagctctgttcataggcttccattctctcccatactcaagccctagtacacggcttattcagagttgccagccagggcagggcactggggaacggggaagccactccaggggcagaagaatttgggggctctagctcaaagctgggagataagcagctagaggacaggcctggggagtgctgtggcagtgtgttccaaatacatacccaaaatgtgttcaatgattgtctcccaacccaaatgctcttctcttatcctgtgggcttgatgctcctcccattgagaggtggggtctctgttccctcctctgaatctttgaatctggcaccgtggcagaagtgatgctggtgacctctgaggctagttcataaaaggctatacagcttctgcctggttatcttgggacattcacctttagaacacaagcctccatgtaagaagtccaaggccacgtggataggccatgtataggtgttctggccaacagccagagatctcagtctataccagcatcttggtataaatcgcttgccaaacatgaatgatgatacctccaaatgactcctggccccaaccatcaagcacctcagccttttgtcatcccaattgaggtcccagatgtcatagagcagagacaagccatccctgctgtgttctttgtgaattcctgactcccagaatccatgaatataataaaatgggaaggaaggtgtgccctcactgccattttgttatatttgtttttatttttatttttgtttttttgttttgttttgttttttgagacagggtctcattctgtctcccaggctggagtgcagtgacacaatctcagctcactgcaccctctgcctcccaggttcaagtgattctcctgcctcagcctccccaatagctgggattacaggcacgtgccaacacgcctggctaattttttgtatttttagtagagacaaggtttcaccatgttgaccaggctggtctcaaactcctgacctcaagtgatccacccgcctcggcctcccaaagcgctgtgattacaggcgtgagccactgcgcccagccttgtttttgatttttttgagacagggtcttgctctgttgcccaggctgaagtgcactggtgtgatcatagctcactgtaacctcaacctcctgggctcaagcaatcctcctgcttcagctttccgagtaactgggactacaggtgtatgctaccatacccagctaattttaaaaaatgtattttaaaatacattgagtggctgggcgcagtggctcatgcccgtaatcccagcactgtgggaggctgaggggggcagatcacgaggtcaggaaatcgagaccatcctggctaacacggtgaaaccccatctctactaaaaaatacaaaaaaattagccgggcatggtggcaggcgcctgtagtcccagctacttgggaggctgaggcaggagaatggcgtgaacccaggaggcggagcttgcagtgagcggagatcgggccactgcactccagcctgggcgacagagtgagactcgtctcaaagaaaagaaaaaaaaaaaaaaaatatatatatatatatatatatatagagagagagagagagagagagagagagtctttcgtctgagccgccaaaatgccatccagactgaggaagacccagaaacttcggggccatgtgagccatggccatggccgcataggcaagctccaaaagcaccccagaggccacagtaatgctggtggaatgcatcaccacaggatcaacttcaacaaatactacccaggttactttgggaaagttggtatgaggtattacttaaagagaaaccagagtggccgggcgcggtggctcacacctgtaatcccagcactttgggaggccgaggcgggtggatcatgaggtcaggagatcgagaccatcctggccaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaaaaagagaaaccagagtttctgcccagctgtcagccttgacaaattgtggactttggtcagtgagcagacacaggtgaatgctgctaaaaacaagcctggggctgctcccctcattgatgtggtgcaatcgggctactacaaagttctgggaaaggaaaagctcccaaagcagcctgtcattgtgaaggccaaattcttcagcagaagagctgagaagattaagggtgtcaaggggacctgtgtcctggtggcttgaggccacatggagggaggttcattaaatgctaactacttaaaaaaaacaaataggccaggtgcagtggctcacgcctgtaatcccagcactttgggaggccgaggtgggtggatcacctggttgggagttcaagaccaacctgaccaacatggtgaaaccccgtctctactaaaaatacaaaaagccaggtgtgatggcgcatgcctgtaatcccagctactcgggaggctgaggcaggagaatcgcttggacccgggaggtggaggttgtggtgagccgagatcgcgccattgcactccagcctgggcaacaagagtgaaaactccgtctcaaaaaataaatataaatttttaaaattatatatatatatttttgggctgtggggagctgggcatagtggctcatgcctgtaatcccagcactttgggaggccaaggcgggaggattgcttgagcccaaaagtttgagaccagcctgggcaacatagcaagaccccatctctatttatttttatttgagatgaaattgcagacatcatagcactttaccccaaaacaaataaatatctatagaaataaatattgcccaggctggtcttaaactcctagcctaaagcgatcctcccactttggcctcccaaaatgctgggattacaggcatgagtcactacacctggccttaaaatggcagttttaagccactgatttggagtaatttgttatacagcaataggtaactagaataaacacctgtaatcttacaaggaactttttggttctatctgaatctaatccaacttccactttcacttttcaaagggataactgaggcctagttgcggaagagactggcaatctgcctactaaccaggagtttctcccaccacgctctcctgaccaagaaggtgccttggaggaagcaaggcctgttctgccacagggtcagtaggcttttcgccttcatccatggatggcttgtggcaaggatatattttttctcccatttatgtgaaaactttgaaactaattgtgtgttctgtgaatgcttagctctcttgaattggggtaatggttattgtttatagagcataagccaagttttatattctacaatgcaaacaggtacctgtttctaaataaaactgtttacattaaaaaaagaaaaaacaaaactttgagggccgggcgtggttgctcatgcctgtaatcccaccactttgggaggccaaggtgggcagatcacttgaggccaggagttcaagaccagcctggccaacatgacgaaaccccgtctctactaaaaatgcaaaaattatccgggtgtggtggtgtgcgcctgtaatcccagctactcaagaggctgaggcaggagaatcccttgaacccgagagacagaggttgcagtgagccaagattgcatcactgtactccagcctgggcaacagagcaaaactccgtctcaaaaaaaataaaaaacccactttgaaacagaaaagtgtgaagaatactatattaaacaccagtgtgcccatcagactttaaaaaattgttaatatattgccatatatgctttccgtatgtataatcatttttatttttattttttttacatgtagaccttaaaatcccaatgtataggccaggcgcagtggctcacgcctgtaatcccagcactttgggaggccaaggcgggcagatcacttgaggtcaggagttcaagaccagcctggccaacatggcaaaaccctgtctctactaaaaatacaaaaattagccgggtgtggtggcgggcgcctgtagtcccagctacctgggaggctgaggcaggagaattgtttgaacctggcaggcggaggttgtggtgagctgaggttgtgccattgtactccagcctgggcgacagagcaagactctgtctcgaaaaaaaaaaaaaatcccaatatatgcataatcttttttttttttttttttttgagatggagtcttgccctgtcacccaggctggagtgcagtggcataaccttggcttgctgcaacctctgcctctcaggttcaagcgattctcctcctgagtaactgggactacagccatgagccactgaccctggcctgtataatcaatttttttttttagacagagtcttgctctattgcccaggctggatggagtgcagtggcacaatcactgcaaccttcgcctcctgggttcaagtaattatccttgagcctcccgagtagctgggattacaggcatgcactaccatgccgggctaattttttgtatttttagtagagacagggttttactatgttggccaggctggtctcaaactcctgacctcatgatccgcccgcctcagcctcccaaagtgctgggattataggcgtgagccacgtcacccggccctgtataatcttttttaccaaacatttgaaatgaaattgcagacagaatagtattttacccctaaatacttcattgtataatgccattatcatttctattacttaatgtttaatacatattcagactgtcccctaattgcccccagaatgttttatagatttttttttcaagccaggatttagtcagtcttcacacattgtatttgactgtctctttaaatccagaacagtctccctcttttttttacaaatgatctttttttttttttttcagacagggtcttgctgtgttaccccggatggaatacagtggcacaatcatagctcactgcagcctcaactttctggactcaattgatcctcccacctcagcctccacagtagctgggactacaggcgtgcaccaccatgtccagcaaattctttaattttttgtaaagacagggtctcactgtgttgcccaggctggtctggaactcctggactcaagtgatcctcccaccttgccctcccgaagtatttggtttacaggcatgagccactcctcctgaccagacactgattttttgaaaagatcaaattaggggtcttgcagattatctcacattctggatttatctcattgcttcatcatagtgtctattaatttgttcctttatcttatttcctgtaaactgaagttaggtctgaaggcttgactgtgaattaaacatttttggcaagaatatttcataggtggtgatgtcagattagtttttattagtaaaattaagcttaactagctaaagtggtgagcaggggtgttttgttttgttttgttttttgtttttttgagacggagtcttgctctgtcgcccaggctggagtgcagtggcacaatctcggctcactgtaacctccgcctcccaggttcacgccattctcctgcctcagcctcccgagtagctgggactacaggcgcccgctaccacgcctggctaattttttgtatttttagtagagacggggtttcatcgtgtgagccaggatggcctcgatctcctgacctcgagatccgcccgcctcggcctcccaaagtgctgggattacaggcgtgagccacacgcccggcgcaggggtgtttttaaattcaaacaagtgttccaacttcactcttaaaaataaaaaagcaacgacaaccaaaaacaaaaccaaaagaagaaaacatatataccagtcctagcaggtaacagtgtaaaaataactggagatcgcgccactgcactccagcctgggcaacagagcgagactccgtctcaaaaacaaaaacaaaaacaaacccctctgatccccgagttttctgggagactgatttgagtaataatacaactctggtctcccgcacagcccgctccgcgcgtgaattaccctttctctattgcaattgccgtcttgataaatcggctgtgtccaggcagagggcaaggtgaaaccccttcggcaaccttacagggctgcccttccgcagctcacagcctaattgctgagagaaattaacctaataatagttgcaaacggaacaccgggcatgcagtgtgaggggctggtccagagcctctgacccacactgggaagtcatggaccgttcaggggtcgggggcgacacaatgtccgaggtctgcgacgtccctcccttgctccctctcatccctgcgactttctttcacccgtcctccacacgaacgagaccacgccaccgagaagaagcctctggggcgcggggctggttagagccccagagccgtcgcagcccggctccaggtgtacctgcgcacaggcgccccacggtgacgtcagggacgcgactcccgcgatgccccgcgggccgcctgatcccaggcgcgggctcagactgggatctcggagttcccctgcgccctcctgacggtgcagtctggcggcccgtggcgcgggcgctgccatggagcatcctggagcctttggcctcggtttacatgggaggcccctcgaaacagggcacgtcacttgccccgggtcacctgcgggcggcgagactctcgggttgactccaaggcctgacattcccctccggttttcacggaggagggtgaggatgttgccaggagctgccgtaaggctggaggagcttgcggttgggtccacccgcctctgggcaggccttagcgttcacccgcggtttctccctgactttgaacccaaactccctaccccgcaagtccttccctgtttgattgctgaactccaagtgacagaagaactgaactgcaagtgacagaagaactaagtgttggcgaaagctgatgctccagagggtgcagagtagaggtcaggggtgggggcctcgccatggggtatgtataatgtagcccagggtcctggcaccgagtctcttcaggaatgcaagggatttggattagatggtgtcttagagatctaaattatccccctttgcaattgcatacctaaagaaaccgctagggctggcatgagcctggaaaaacacaggcagggttaatggccctgtcctttagtcagtggccccacacttcttccagtgactcagaaggggcccctggagtcatgcaaatggaacatatccatcatgcgccaaaacgtgcttgtgtctccttgtaatcccttcctctccacaaccattgtcactttagattggtttctgtcactttagatttgtgtgtaacttctagagtttttttttttttttgaggcagagtctcactctgtcatccaggctggagtgcaatggcgtgatctcggctcactgcaacccctgcctcccaggttcaagtgattgtcctgcctcagcctcccaggtagctgggattacaggcgtcagccaccgtgcctggcctagagttttatataaatagtcttataggccgggcatggtggctcacgcttgtaatcccaccaccttggtaggcctaggtgggtagatcacttgaggtcaggagtttgagaccagcctgacatggcgaaaccctatctctactaaaaatacaaaaattacccgggtgcagtggcttgtgcctataatcccagccacctgggaggctgaggcagggcaatcacttgaacccaggaggtggaggttgcagtgagccgagaacatgccactgcagtccagcaggggcgacagagtgaaactccatctcaaaaaaaaaaaagaaattagcctggcatggtggtgtgtacctgtagttccagctactcaggaggctgaggtgggatgatggcttgagcctgggagatggaggctgcagtgagccaagatcgctccactgcactccagcctggactatagagccagaccttgtctctaaaaaatttaaaaattaagaaaaaaatcatacagtatgctctcttttgcttcttttggcacagtttgtaacttatttatattttatcaataatttattccatttgctgagtagtattccactgtatggatatatttgttttttatctataatttgtttattcagtcacctgttgacatttaggttgtttccagtttggggttgtaacaaacaaagctatctaaaagctttgtgtggagatatgtattcatttttcttggagtgactagatgatatgataggtgtatatttaaggtttttttttcttctttttttgagacagagtttcgctttgttatccaggctggggtgcagtggcgtgatcttggctcagtacaacctccacctcccaggttcaagtgattctcttgcctcagtctctcgaatagctgggattacaggtgcgcaccaccatgtccagcccttttttttttttttttttttttttttgagatggagtcttgctctgtcgcccaggctggagggcagttgcgcgatctcggctcactgcaagctccgcctcccgggttcacgccattctgcctcagcctcccgagtagctgggactacaggcgcctgccaccacacccggctaattttttgtattttttagtagagactgggtttcaccatgttagccaagatggtctcgatctcctgacctcgtgatccacccgcctaagcctcccaaagtgctgggattacaagcgtgagccactgtgcctggccctatttaaatttttaagaaacagttttcaggctaggcatggtggctcaagcctgtaatcccagcctttgggaggccaaggcaggtggatcacgaggtcaggagtttgagaccagccagtctgagtcaccccggtcaacatggtgaaaccccgtctctactaaaaatacagaaattagtcaggtgtggtggtgggtgcctgtagtcccagctactcgggaggcccaggcagaagaattacttgaacctgggaggcggaggttgccgtgagccaagatctcaccactgcactccagcgtgggatacacagcgaggctctatctcaaaaaaacaaacaaacaaacaaaaacagttttcaaagtggttgtacaattttacattcccaccagcagtatttgagaattctaattgctccccatcttcatcaacatttggtataattagtctttttaattttagccattctaataggcatgtaaatctcattgtggttttaatttacattcccctaattacatggtattgagcatcttttcatgtgcttttgccactggatataggatttgcagatggatcagatacgtgatgtgagagaagagtcaatgattttgaacccttgccgatccctgagtacttcctaatccccctcctccttgccatgtgctggctatttcctgtgccattccctgcattgcaaattcctaaatcatccagctctaaagagccttcagtgatcctgttgggtgggcactcacagtcctggcaattgatcttcacctgtacagagctaattttccactcattatcttctgtaccagttggtgagcttcctgagaatatggatggttggattttctcgttatgactaacctctagttgtagcccagactcagactttgagtatacatcacaaatggtactctccaatctcatatcaagttgtggatgttttgcttcaagctaccagcccttagctatgtgatcagtgccatttacttaatatctctgtgtcttaatttgtttgttgttaaaatgttacctgccgcacagagtaataagcattaaatgcaaaataagccagcgcagtggctcatgcctgtaactccagcaagttgggaagctgaaatgggaggattgaacccaggagtttgagcttgtttgagctcaggagttcgaggctgcagtgagctatgatggcaccattgcactgcagctccccagattggagtgcagtggtgccatcataactcactgcagcctcaaaccagagtgagaccccatctctaaaaaaaaaaaaaagccaaaatgaatgtaaaactcaatatggtgccaggcacatagtgtcttccctaaaaaaatcatcctgttattcttatcttttttttttttttcctagacagggtctcactctatcacccagctcagagtgcagtggcaagatctgggctcactgcaacccctgcctcccaggttcaagcaattcttgtgcctcagccttccgagtagctgagactacaggtgagtggcaccacacctggctaatttttgtattttcagtagaaatggggtttcaccatgttggccaagctggtctcgaactcctagcctcaagtaatctgcccaccttggccttccaaattgctgggattacatgcgtgagccaccttgcccagccaagctgttgttattttctgatctgaatactttgatagtccatttctgaaactcaaagataggtgttttgaaaatggttattaatgtaatctcaatcttttgagtagtaaaagctgactttgggggcctggcacggtggctcacgcctgtaatcccagcactttgggaggccaaagcaggtggatcacctgaggtcaggagttcaagacaagcctgaccaacatggtgaaaccccatgtttctactaaaaatacaaaattagccgggtgtggtggtacatgcctgtaatcccagctacttggcaggctgaggcaggagaattgcttgaacccgggaggcagaggttgcagtgagccaagatcatggcgccattgcactccagctgggcaaaaaagagcaaaactgtgtcaaaaaaaaaaaaaaagcaggtattgaattagtttgattccttgaatcaagtaattgaattgctttccttcctccttccattgagatccacattgttgtagaaagtgtccctttccaggctgagtccttggcctcttatgtctatatggccacttgtttgctaccatgtctctgttctctacactgatgccctggagtgggacagaagagtctgaaaaacatccctttgtttcaaaatctctctctctcatttttagtagaaacgagatctagctgtgttatccaggctggtcctgaactcctagcctcaaactatcctttcaccttggcctcccaaagtgttgggattacaggattacatgtgagccactgaacccagccaacaggtgtatgtaatagtttaaggagacttggtatttaggttttgatttaacaaatttttttgtacagacgggggcggggggtctcactatgttgcccaggctggtctcgaactcctggctttacacaatccttccaccttgccctcccaaagtgctgggattattacaggtatgagtcactgcacctggtcccaaatctctttttgagacagagtcttgctctgtcacccaggctggagtgcagtggcacagtttgggctcacggcaacctcctcctcctgggttcaagtgattctcatgcctcatcctcctgagtagctgagactgcaggtttgtgccaccatgcccaggtaatttttgtatttttagtagatatggggtttcaccatgttggccaggctggtctcaaagtcctgacctcaaagtaatttgcctgccttggccttctaaagtgctgggattacgggcatgaccactgtgcccagcctgaatctcttttgatgacccatattttatgagatacaattcaaactctagcattcccagctttctcacttgaggtccaagcctttctaactctccagcccaaatgttagctttgtaacattgcatccactcaatttaaatggaatgtgtagaaccccttccatgagtacctaccagaagccaagctatagtaaaggtctgaagcttaaaatgtgcacaggctgtcctttctcttgagagagaaataaaatggtggaggaagtgtgatgaggacaagaatgataaggaggatgctctggaggtggagggggaagactccagccagaagggccatgtgattctacttatcatcaattagtgtttggtgtccaagctggtgctgagccctgagcatttaataaattgatttgacccttatcttcccaacacagggtcaggcctgggggttggggcaaattgtggaataaccaaatacctggagcctccctgtccaaggagggcgtgttcaggaaaagtttcccagcagagataaattctgtatgttactagtccagagtccagggaccactcccaggtgtggtttcactcgggacactgggaatcctctctccaggggatatctgttggtatgatgataactggagaggaaatgtgtggagatcatcagattccatctggcactagggtgatctccctgctgcctgactcacagcactgactccaggcttctttggctctggggcattggttaactggccccagttccaggttgcaagtgcactctgcagctgttccctgcctcttgctttgggcagataccttgcccaagctgtcaggtcctgcctctccctgaaatgggatgactaatgtgtggacctcaaaggataagagtgagggcagctgaagaattacagtagtaataatagctaacagtaatatagttctttttttgctgggcgcggtggctcacgcctgtaatcctagcactttgggaggccgaggtgggtggattgcctgagatcaggagtttgagaccagcctggggaacatggtgaaaccccgatctctattaaaatacaaaaaattagccaggcgtggcggagtgcttctgtaaccccagctactcgggaggctggggttattgagacggagtcttgctctgttgccaaggctggagtgcagtggcacgatctcagctcactgcaacctccgcctccaggttcaagtgattctcctgcctcagcctcctgagtagctggagttacaggtgcatgccgccacgcccggctaatattttatatttttagtagagatggggtttcaccatgttggccaagctggtctcaaactcctgaccttaggtgactcactcgcctcagcttcccaaactgctgggattacaggcatgagccactgtgcccggccaatatagctctcattatgtgccaggaactgtttttggtgctttacacatattaatttatttaatcctataattacctacaaagtatagtgattaagagcatagactctagaactagacaggccaggtttgaatccctgctctgccatttactagcactgtgaccttggggaagtctgtgcctcagttttcccatctgctaaaagaggataatcccagtatctacctcatagagttgttacaaggattaaatgagttacaatttataaacagaatgctggctggaaatattagctgggcatggcggcgtgctcctgtaaccccagttacttgggaggctgatagtttaaaaactatctaaaattttgataaatcccatttttccaggtgagaaaactgaggcacagaagagttaggtaattggctgggcatgatggctcatgcctgtaatcccagcactttgggagtctgagtcgggtagatcacctgaggtcagaagttcaagaccagcctggccaacatgatgaaaacccatctctacaaaaatacaaaaaatagccaggcatgctggcgcattcctgtagtcctagctactcgagaggctgaggtgggagaatcatttgaatccgggaagtgggggttgcagtgagccaagatcacaccactgcactccagtctgggcaataaagcaagacttggtctaaaaaaaaaaaaaaagttaagtaatttgcctaagataccgcaactgaatggtggagctgggactcaaaccccaggaagtttggctgtggaggctgtgctttcaatgaagtgggcatgtccacattaattactttataaggggagtgggcgggagaaaccctgaattaagtgatgtggaagcttctagcacttaagatgtgagttagtcttccttctgtggtaagtgaagtttgcagcagctggtggctggactgtccccaggtggccagcagcttctggaagggggctctgaggcctgaacaggggctaaaaggctggggtttgatttggtttcttcagcgtcctgtctcagagctcatttatcttcctctcagcactgctcccaggaagtccagtgtgacttgatccttggtacttggtaaatgtcaatctaatatagaaaacctttgctaaatctcaaggaaagacagtctcactgtctgtcgcccaggctggagtgcagtggcgggatgacaagggcttgagcccctcgaactcctgggctcaagcaatcctcctgcctctgcttcccaagtagctgggattacaggcattcaccaccacagccaggtaatttcttaattttttgtaaagacagggtctcactctgatccccaggctggtctcaaacttttggactgaatcagttctcccacctcggcctcccaaactgctaggattactggcatgagccactaaatctgggctaatctctgggagtttaaacccaaggtaaacaattcaatgcaacaaacctttgcctggggcttcttatgtcaggtcttctactgggccctggagatactggtgtgcattgagaggccacctggacctcaggatgctcccagttcaaagggggaaatgcagaagtctacaggcagattgtgggcagtggaccccaaattaaataggaatcagccacgtgggaggggcaggaagtgttcctgccctgggtaatggctcaggcaaaggcaaagaggccgtttcttttggccagggctgggtggtggtctggaagatcagataaatgtgattgtggagtaaggaatttaccctgagggagaggaggatggttttaaattctggaaagagctcacgcctgcaatcccagcactttgggaggacaaagcggcaggatctcttgagcccaggagtttctagaccagtctaggcaacagcaacatagcaagacacccccttctcttaaaaaaaaaaaaaaaagcgcagtggctcactcctgtaattccagcactttgggaggccgaggcgggcggatcacgaggtcaggagacctataccatcctggccaacatggtgaaacctcgtctctactaaaatactaaaaaaaaaaaaaaaaaaaaaaaaaaattgccgggcgtggtggtgtgcgcctgtagttccagctacttgggaggctgaggcgggggagtcgcttgaacccgggaggtggaggttgcagtgagtcaagatcgcgccactgcactccagcctggcgacaaagcgagacaccgtctcaaaaaaaaaaaaaaaaaaaatcagccgggtgtagtggcgagtgcctggtcttagctacccgtgagttgaggtaggaggatcgcttgagcctaggaggtggaggttgcagtgagctatgatcgcgaaactgcactccagcctgggcgacagagcaagaccctgcctctaagaaaaatgaacaacaaaaaataaagtctattaaggagggtctcttggaggcaggagaggaagcagggagaggcacaggtagggtgaggagccgctttagggtgcggctctagggacccagtagtggcttggactagcgtgggggattccgccctggcgctttccctggctggctctcccatgctcgcgcctcgctccccttcctcggtcttcgctatgtgggatactcctgggccgccccggactgacacgtgagccaggcctcggtcacatcccggcccgctccacaactccgaagtagcggccgccgcccctgtcctgcagccggccctggagggtctgggcaggtgccgccccgcaggccccgccccgccccgccccctggctccgcccctcactcaggcccctcccccggcgcccgcgcgccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctggtgagacgagccgggagggcttgggcccctccccctccctttaactcacccctcccccacccagatacccccgaccctccccaggctcccaccaagctggggtgtgtgtgtgtgttgggggtggggtgtttccgcggaaatgctgcgtcctgggccctctgaggcaggggcgcgcgtaaagctggggggctcttgggcgtccctcgcggctccccaggcctgttgggcctcggagctgggacgggcgggtctcttgggacccgggccaagccgtgcatgatgtcattttgtctcccgcctaattgcgggatgggggtgggccggccggtgtcagctggcagggccttcgccggcgagggaggcgacccctgggagcgagagggagtcttcaagtcccagccagtgggagaccgagcctgggaggcacttgttgcagcctagttttgggtcaacttggtgggtgggctttgctccttaacattccggggagcacagagtcccccaagccctctcccctggactgagaagggtgctgagttgggggctcttttgtctctcccacctgggttccgcgccccagcttggttcggtttgagacctctcttcctgttcccacgaggagttttgggcagctggggttgaaggtgcgggggagagagagagtccctggggcaaaggcaggaactgcggtctccattttacttatttccccagagacttaagtggcagagctgagcccggagccaggtctgtggctccagatccctgtcttacacctgtgcgcctggggcctgagctccaagcttttcagcctgcctgggagacaggacagtggggtcctgacctcttccctgcctggatcgctgcagctcagataaccttcgttccctcttttttttttttttttttttttttgagaaggagtctcgctctgatgcccaggctggagtgcagtggcgcgatcttggctcactgcaacctccgcctcccaggttcaagcgattctcctgcctcagcttcccgagtagctgggacttcaggcacgtgtcaccacgtcgggctaattttttgtatgtttagtagagacagggtttcaccatgttagccaggatggtctcgatctcctgaccttgtgttccgcccgactcggcctcccaaagtgctgggattacaggcgtgagccaccttgcccggccaaacttcggtccctctttagacgatagcctcatctaaagatgaagccttccatccctctagatttttgccctttcaggctgaggatagggatctgagcacagggactgtgttcctcaggccccactttcccaggccaatgtccaggaagagttttctgttcaggcgcctatcagaccctgccctggttttttttttttttttttttgaggcagggtctccgtctgcagtccaggccggagtgctgtggtgctgtcatagctcactgtagccccaacctcccaggttcaagtgatcttcccaactcagcccgctgggactgcaggctgagtagctgggactatgggcacgggccgccacaactggctaatttatttaattatttaggagacagagccactctgtgttgcccaggctggagtgcagtggcacaatctcggctcactgcagcctctgcctcccgggttcaaggaattctgtctcagcctcccaagtacctgggactatgggcacacgccgccacgcctggctaattttttggatttttagtagagatgggtttcactgtgttgctcaggcaatccgcctgccttggcctcacagagtgctaggattacaggcgtgagccaccgcgtctggcgtgttttattttgtgtagagatggaagggggcgggagtggcctcgcgttgtgtctcacctcactatgttacccaggctggtctcgaactcctggcttccagggattctcccccacttggcctcccaaagtgtcgggattacaggtgtgagccaccttgcctggcgccatcctgattttttgttcaggaagagttattccaggagtgactgcctctagaccaccccaggtcctgggctacttctcccatgaggggctcagtggaggaacccctcctgtgtgaaggatggcagctccacagccctcagcccatttcctggccacttgctgtaactctcctctgccctagtgccccacttcccgctttgtctctgactcacccctgtcctggagcagagcccagcacgttgaagggcaaaaggtagggtatgttggaccacaatgtggttgccaccactaactggactctgctttttcagctgggattaggatatgaggacttgcaggtgtctggagttaggaaggttcagagcctggctctatgaacttggcaggtggcctcacccctctgagcctcaatttccgcatctgttaagggggataatgagaatgtgggtgaagttgatggccagcacatatggtaaagtatatcatctcacagaaatgccccagctgtctgagatgctgaccctatcaaacagcattggaggctgggtgtggtagctcatgcctgtaatcccagcactttgggaggccaagagttcaagaccagcttgaccaatatggtgaaactcctcgtctctaccaaaaatacaaaaattagccgggcgtggtggtaggcgcctgtaagcgcggctattcgggaggctgaggcaggagaattcacttgaacccaggaggcagaggttgctgtgagtcgagatcatgccactgcacttcagcctgggtgacaaagcgagactctatctcaaaataaacaaacaaacaaacaaacagcattggagcaccagggagtgtccatgcagacatcatttcatccttgaaagaatatttgctgaccttctgttagaagccaggcctttgtgctggatgctggagaagcaaagatggtttctgtcacgagctgtctgggggcagttgattttaaagccaacttcattctgttattagtatcttctggatttttgccttctatattgaagtggtggaggacccatgaactgggtcaggaatgaattccagatccttctgtattgctgactgtagacaccgtccctcctttcctatttctgaaaatttttttcttttgaaattgggtcttgcctggcctaaaaaatttaattagtatttcttattgactaataggcagcagctttgcacattttttcatttatttgtatattcagtcagtccctgggcaaacatttcttaagcccttttggtgataaaccctgggatgccaaggtggagctgacctttgtagatgatgtggaggagacaggcagttgcagtgtaagggcccgagacaggagggtttcccatgtgctatggaagtataggagtgactctaggaagcaacggtgagctttggagaacaaggagaaggtaatgtggatagcacagtaagccttctttcatttgtttcatttccaaacaagacttgccttgtttggaaacctgtaagctttttccagtttacaaatgtctgacctagcaacttacctgaccaacgtgacctgatgcaggtcctgtcgggtggagttggggaaagattactaactttcctcaagcacctgacatctctggaggtggatcctatgatttcttttttttctttttttttttttttttgagacggagtctccctctgttgcccaggctgcagtgcagtggcacgatcttgactcactgcaacctctgcctcctgggttcaagcaattctcctgcctcagtttcccgagtagctaggactacaggtacatgccaccatgcccagctaatttttgtgggtttttatttatttattttttttgagatggagtctcgtctgtcgcccaggctggagtgcagtggcacaatctctgatctctgctcactgcaacctccgcctcctgggttcaagcagtttttctgcctcatcctctcgagtagctgggattacaggcgcatgccaccacacccagctaatttttttgtatttttagtagagacatcatttcaccatgttgaccaggctggtctcgaactcctgaccttgtgatccacccacctcggcctcccaaagtgctgggattacaggtatgagtcaccgcgcccggctgatttccattttttttttttttttttttttttgtgagatggagtttcgctcttgttgcccaggctagagtgcaatggcttgatcttggctcaccgcaacctccgcctcccaggttcaagcgattctcctgcctcagcctcctgagtagctgggattacaggcatgcaccatcacacccggctaattttgtatttttagtagagacggggtttctccatgttggtcaggctagtctcgaactcccgacctcaggtgatctgcctgccttggccccaaagtgctgggattacaggtgtgagccaccacacctggcccgatttccatttttgtaactattaaactggataaatacgaggattttttggagcaacttggaagattgccttgtagagtaaaaacacccagaattcaaagcagctcgtactgttttttttttttcccctacagcggcgttagaagatattgtacactgggccgggcgcggtggctcacgcctgtaatcccagcccgttgggaggccaaggcgggtggatcacgaggtcaggagttcaagaccagcctggccaagatggtgaaaccctgtatctgctaaaaatacaaaaaaaattagccgggcgcggtggcaggcgtctgtaatctcagctactcaggaggctgaggcaggagaatcgcctgaacctggggggcagaggttacagtgagctgagatgtcgccacttcactctagcctgggtgacagagtgaaactccgtctcaaaaaaaaaaaatagatactgtacactgatttttctctccattaattatgcctgtgtgtaggcaaggattgaaaagggatttgcaaaaatggacataagccagacacggtggtgcacacctgtaatccaagttactttggaaggctgaggcaggaggatcccttgagcccaggagttcaagaccagtctgggtagcatactgagaccctgtcattacaaaaaaaaaaaaaatcaacacacgaaaaaacaacttggccagtcacagtggctcaggcccgtaataccagcactttgggaggccaaggtgggaggattgtttaaggccaggagttccagatgagcctaggcaaaatagtgagatgtttctacaaaaaaatacaaaatagccaggcatagtgtcatatgcaagttgttccaggtacttgggaggctgaggtgggagaattggattgcttgagcctaggagttggaggctgcagtgagctgtgattatgccactacattccagtctgggtaacagagccagactctgtccctaaaagaagaaaaacaacaaatggacatagagaatatattcagaattttttttccaaataactaatatctcttaaaatcttgatgcctgttaacttcatcaactttattccttaaaatatccatgcaggtttgttactgaaaggaaaaagcgatagtctgattttgaacataatattcttggtgaaatcttaactttctttttccttttctttttttgagacagtcttgctttgtcacccaggctggagtgcagtgacatgatctcggctcattgcaaccttcacctcccgggttcaagcaattcttctgcctcagcctcctgagtagctgagattacaggcatgcgccaccgcacccagctaatatttgtatttttagtagagatggggtttcactgtgtttgatcaggctggtcttgaactcctgacctcaagcaatccacccacctcggcctcccaaagtgctgggattacaggtttgagccactgtgcctggcctcttttttttttttttttacagcttttgaaatcactagggcattcctgaaaataaaaaagaagaaagtagctcttaaccctatttcattaaaaaatttaaaaagaggtgaggtcgggtgtggtggctcatgcctatagtcccaacactttgggaggccgtggtgggaggattgcttgagcccaggagttcaaaaccaccctgggcaatatggtgagaccccgtctctacaaaaaatacaaaagttagccgggcgtggtggcatacccctgtagtcacagctacttaggaggctggggcgggacgatcatttgagtccaggagttcaaggctgcagtgagctacgatcatgccacactgaattccagcccagtgacagagtgagaccctgtctcaataaaaataagtgaagcagaagtgcctatgtcttaaaaagaagaaaaagtaagagcctctctcccccagacctttccctagggtgggctggccgctgcctacacgttctccattatgtaaaacatatggacacaccatccttgacccttggcctgctttccccatagcgaggatctggatgagctgcactaccaggacacagattcagatgtgccggagcagagggatagcaagtgcaaggtcaaatggacccatgaggaggtgagtgccatggggaagagagggttgatggcagctgggggctgtccagaggaactgagcctggagtgtatttgatgtctcatcagatgggatgaagaggaggagccggtgaaggaagggatgggtcctctgattgtcctcatgcctcttctcagagcattctgggggattctcaattttgaggactcagtgggtgggaaggggatgtgtgtcctagacctcagggcccattgtgtctcctgagcagctgccatgttctatgtcatggacattgattgtgctttttgccttttgactgctaggaggtttggccaaatctgtaactccccccaccctttttttttttttttttttgagacagagtttcgctcttgtcacccaggctagagggcaatggcataatctcagctcactgcaacctctgcctcctgggttcaagcgattctcctgcctcaggtgcgattacaggcgtgagccaccacatccagctaatttttttttttttttgagacagtctcgctttgtcacccaggctggagtatagtggcatgatcttggctcactgcaacctctgcctcccaggttccaagcaattctcctgcctcagcctcccgagtagctgggattgcaggcatgcgccaccatgcccagctaattttttttttttgtatttttagtagatacgggggcttcaccatgctggccaggctggtctcgaactcctgacctcatgatctgcccgcctcggcctcccatagtgctgggattacaggcgtgagccactgcacccggccttaatttttgtattttttagtagagacggagtttcaccatgttggccaggctaatctcgaactcctgaccccaggtgatccacctgcctcggcctcccaaagtgctgggattacaggcatgagtaaccgcaccctgccaactcccactttctttttctaaaataattaactgtattgaaccttctgacatcaagccctgaattggtttccttctagctccatctttttattttataataaatgtgattgaaatataatttatatgtaatcatatgcaatcaaatgccctttttttaattcctttttgagacagggtttttgctctgtcacccaggctggagtgccgtgctagcatggctcactgtagcctcaactttctgggctcaagcaatcctcccccgtcagcctcctgagtagctggaaccacaggcatgcgccaccacgcctggctaatttttgtattttttgtagagacagggtctcgccatgttgcccaggctggtctcaaacttctaggctcaagcatttctcccacctcagccttccaaagtgctaggattataggtatgagccactgtccctggccaaatgcccctttttatggtgaacagtttgatcagttttttttctttttttttttttgagatggagtctctgtctcccaggctgaagtgcaatggcgtgatctccactcactgcaacttccgcctcctgggttcaagcgattctcctgcctgagcctcctgagtagctaggattacaggcacccgccatcatgcccagctaattcttgtatttttgtagagatggggtttcaccatgttggccaggctagtcttgaactcctgacctcaagcaatccacccaccttggcctcccaaagtgctgggattacaggcatgagccactacggtgagccggtttgatcacttttgacaaatgcatataccaatgtaagcaccaccctgattatcccaagaagttttctgtggtcctttgtggtcaggcttccccagctccaggaaattgctgatttgatttgttttgcctttttctttttgggggctttgtgtgtgtgtgtgtgtgtgtgtgttgtttttaactttaggttcaggggtatatgtgcaggtttattatataggtaaattgcatgtcgtgggagtttgatgtacaggttattttgttacctaggtaataagcgtggtacccaataggtagtttttttttttttaaggcagtctctctctgttgcccaggctgtagtgcagtggtgtgatctcagctcactgcaacctctgcctcctgggttcaagcgattctcctacctcagcctctcaagtagctgggattacaggcacgtgccaccacgcctggtaaatttttgtatttttagtagagacaaggtttctacttgtctctactaaaatgttcaccaggctgatcttgaactcctgacctcaggtgatcttcccacttcagcctcctgaagtgctgggattacaggcgtgagccactgcacccagccccaataggtagttttttgatcctcatcctcctcccaccctccaccctcctcccaccctccaccctcaagtaggccctggtctccttgttcccttcttcgtgtccatgtgtattcagtgtttggctcttacttatagatgagaatatgcggtatttggttttctgttcctgtgtttgcttaggataatatgttttgcctgttcttgaatcttctataaatgaaatcatacggttacattctttgcgtctggcttttgctcagcattgtgttgggtgattcagtaacttgtccttttctatcactggatagtagtccattgtatgggtataccacacagcgtttcacctgttgatggatgtttggactgtttgcagtttttggctatcgtgtatagcgctaccttgaagattcttgcataagtctttttgcaaatacatgtttccctttcttttgggaagataggtatggtcatggggtaggtgtatgtttagttttacagaaactgcctttttcttaatggattgtaccattttagacttctactggcctttttattttacctcagtttttcttagtgtcttcagttcttcagtgttttttgttttgttttgttttcaacccatagttaacatcatagatgtctttaattttaggattgggtttttttttttgtattgtattatttgtattgcttttgttttttgtttttaaatagagaagagggtcttgctatgttgcccaggctggtctcctgggctcaagcaatcttcctgccttggcctcccaaagtgttgggattacaggcagaagccaccatgactagcttgttttgttttttctaaaacttgctgtgtgagtggtaaactccttttaaatcatgaaagatgtttttccagatgcgtgctaagcaaaccttttctgctcatcctgttgtggaccagggactatatttggctcttgtgggcttagaagaataaacaagaccaagttcctaccccagagcagatttctctctggaatggagagataagaccgtgtgcaggtccctggaatgtgctgtggtcatccgcggcaccggtaggatcagtgtctgttggtgctcactgttgtagctctgggcacctgctaattgtaagatgagtggatggcaagtacctttagaaggagagattactgctgcctgaagaggttaaggaaacttatgtggagaaagtgacctttgagctaaggatgaggatttggaaatttagcagtgagggaagacctacagtgtgcaaaaagtgggtaagtcagatcaggaaaggggctataggtggagaaaagccagtacaggaggccagtttggtgggagggaagggtccttgaaggggagaaatggttgacggagatggccgcccggccacccctactgggaagtgaggagcccctctgcctggccagccgccccgactgggagggaggtgggggggtcagccccctgcctggccagccaccccgtccgggaggtgaggggcgcctctgcccggccgcccctactgggaagtgaggagcccctctgcccggccaccaccccgtctgggaggtgtacccaacagctcattgagaacgggccatgatgacaatggcagttttgtggaatagaaagaggggaaaggtggggaaaagattgagaaatcggatggttgccgtgtctgtgtagaaagaggtagacatgggagacttttcattttgttctgtactaagaaaaattcttctgccttgggatcctgttgatctatgatcttacccccaaccctgtgctctctgaaacgtgctgtgtccactcagggttaaatggattaagggcggtgcaagatgtgctttgttaaacagacgcttgaaggcagcatgctcgttaagagtcatcaccactccctaatctcaagtacccagggacacaaacactgcggaaggccgcagggtcctctgcctaggaaaaccagagacctttgtttacttgtttatctgctgaccttccctccactattgtcctgtgaccctgccaaatccccctctgcgagaaacacccaagaatgatcaataaaaaaataaataaagaaagaaagaaagaaagaaaaaaaaaaaaaaagaaaggatacactggggctgattcctcgagggccttgaatgttgggcttagaagctgtaggattgttcagctctcaatgcagagccaggttagcttggtttttggattgttttttctaactctgaactggacaaagatggaaggtttttaatgcagggagtgatgtgaatgtagccgggcttcaggggagttcatctgctgtgtgggggatcgataagagagatgggtggcctggcgcggtggctcacgcctgtaatcccagcactttgggaggctgagatgggtggatcacctgagattaggagttccagaccagcctggccaacatggctgaatcctgtctctactaaaaatacaaaaaattagctgggtgtggttgtgggcacctgtaatcccagcaatttgggaggctgaggcaggagaatcacttgaacccagaggcggaagttgcagtgagctgagatcgcaccattgcactccagcctggacaacaagagcaaaactccgtctcaaaaaaaaaaaaaaaaagaaaaaaacatatagagcacaggctggggctgagagaccagtgctgagggagtgggagagggcgctgtgccaggcaagcaagaggtggctgtggagagggcagtgcggggatggagctgaccacgttggggagtcccagggtgggtgggaagaatgtaagtttggaaatgatagtatccaggtcagttgtcagggagagtggtggtgccagagatggactggggaacacagaaggaagcaggtaagagcctggccagggcagggaggggacatggtataggtagggaagggtgtcctgggctggctcacccagagaatttatggtgactttgcccagcctgtgctggttctggccaagctgtagttgagggctttgatacctgtcgtgggccacgttgtgaccaatttttctgtctaggagcatgtatacatatatacacatataaatttgtatgtgtgacaaaaccacctcactttaaatttatccccttttcctcccccttaaatctaccccttaaccatctttaactttgtagttcagtggtgttaagtattttcagattgttttgcaaaagatctctaaaactttttcatctttgaaattggaaacgaggctgagtgtggtggtttatgcctgtaaaccgagtactgtgggaggccgaagcgggaggattgcctgagtgtaagagtcctagaccagcttggaaaacatagcaagaccctatcattaaaaacaaaacaaaaaatacccaccaacttggtgggtcacggtggctcaggcctgtaatcccagcactttgggaggccgaggcaggagattgcttgaggcagtctagaccagcctgaagaacatgtgagatcctgtctctacaacaaaaaaatgaaaattagccaggcctggtggtgtgtgtctgtggtcccacctacttgggaggctgaggtggaaggatcacttgagcccatgaggttgaggatgcggggtgggctgtgtttgcaccactgcactctagcttgggtgaccaagagagaccctatctcaaaaaaaaaaaaaggatggaaaactgaaactaattaaacatgaattcactctcctcccaccctccagcccttggcagctatctttctactctgtttctgtgattttgactattttatttatttattttattttttcaagacagagtcttgctctgttgcccatgctgcagtgcaatggcatgatcttagctcactgcaacctctacttcccgggttcaagtgaatcttctgctgcagcctcccgagtagctgggatcacaggcgcctgccaccacgctgggctaatttttgtattagtagagacgaactttcaccatgttggccaggctggtctcaaactcctgacctcaggtgatccacctgcctcggcctcctgaagtgttggggttaaaggcatgagccactgctccctgcctgattttgactattttagatgcttcctgtgagtggaatcctgagtatttgccctgtctggctatttgacttagcatagtgtcctcagctttcatccatgctgtagcatgtgtcagaattctctcgactgagtaatatccattgtttatatgcatgacattttctttcttttttcttttgtttgagatggagtctcactcttgctctgttgccgaggctggagtgcagtggcatgatctcggctcactgcaacctccgcctcccaggttcaagcaattcttcctcatcctcccgagtagctgggattacaggcacccaccaccacacctggctaatttttgtatttttaatagagatggggtttcgccatattggccaggctggtctcgaacccctgacctcgtgatctgcccaccacggcctcccaaagtgctgggattacaggtgtgagccactgcgcctggcttgacattttctttatatattaattgatttgactgaggaaaactttatatataattaactacaaccatttgtagtacaattcagtagaaccaccagcacagccgggctataggacatttccattgtccccaagacattccttgcccccctttgctgttcatccctttccaccactggcctcagacaaccactttttgtccctatagcttagtttacattttctagaacttcatgtgcatggaatcatacggcatgtaccctcctgtgtctggcttctttcacacatcatagtgacactgagattcatgttatcgcgtgaattggtagttcatttcgggaggctattttgatagatactagcctgtcttctaactactcttgtttttgcccagacctccagcttctagtgctgaatcactgtcagctctggcctgagttcagtaatgacctccttatgtccgctcggctcccttccagcccctttcccaccctgtagcaggcaaagagaactttacaaagttctcttcatagaacgtttgactgtgaccacccactcttcaaacacatcagtggttttgcatgatagatggttgaactgatgctgcgaatggtctggcccctatggttccctccaaaatcatcttggatctgttttgcttcctccattttagctattctgcatttccttggaacctgtcccttagtgtccctgagtaggcagtcaccacgtacctctccatatctcccagcagggggtggctttacttttgttcctgtgagccttccattggcagctggctccctcccatgagatcaggggcagctcttttgctgcctgctgctgcagctgtagtgcctggcaccttgtacgtattcacttcatgacggaatggatgaacgaggctgttcttttagattgggctctgtcacgggcagccctgaggttttctgcacgtatgtgtgctgagcccctgtctttctggtgttggcaggacgagcagctgagggccctggtgaggcagtttggacagcaggactggaagttcctggccagccacttccctgtgagtacagtcctgctgtggccctccctcggggcaagggctctgggagaacagtgtgcctgggacagactttgccaaggaggggaaaagggagttccttactcagcccctgaaaacaaaaccaaataaaacagggcaaatggacctttgtaggatctctcttcccaagctggcattcagggtacactgctgtaaacatcttccagctcctcagcatgcctggtggtcttcaggctctgagacatttgcagcatgtggtgcatatttgcatttcttcctgtaagtcaggagtgaacaggtgttcggtttctcaacagtgagactgaaactgaggggaagtgatgctttcagcaggcttcatggtgaggcccctgcagggctggcaggtgctaccacattcgagtatttagagcctcctgatggtgagggggttcccctcaggacctccttctcaggccctcccacccctgacccacaggtgtctgggagggagggggtgtggcaggagctgccatatgtcttactgcctgggctgctcagaaagcatgtcaccagatcctttcctgccccatttcctcatctccccctcttctgtgtaatctgaactcttcagggaataaaaatgctctcctagaaaaaagcaggggtccctgacgtacaaggaattaaagacttgtgatggtggccccttgtgttcggttggtagggagcggcttcccacaggggaccgagtttgccctctcgtgtagcaaagggaaaccgcccatgttccggcatgtgggcttgcagtgagtggtggctgcatggaacaggacacacctacccaaggtgtgcctagtcccaggccataggcccctgagcctagtacttaaccaggcccccagcccgaggtcccagaagttctcacagattggtttgttcttctgttcttttcccagaaccgcactgaccagcaatgccagtacaggtggctgagagttttgaatccagaccttgtcaaggggccatggaccaaagaggaagaccaaaaagtaactgctgggacagtgccttgcacacagtgggtcttcacccaccagtgtacctggggactgtgagattgccttgtgttggggttgggggtgtcaagctgagcattgggtgtgagttgtctaccagccagtctggacactcttatgctgccctggctccagccctgagattccaagtttcagagtgtctccaggcttcctcactcatggtctgagggctattgggctgattactcggcttctcttgttccacccatggaggggagcagtagcagtgcagcgttgtcatgagaattaagcaggtgatgcttgtagggggcttgcaggttctgtacatttgctctcagcaaatggcagctgctgctatccctgatttaatgatgattgcaccctgtgaccttcacagggcacagatgccttcttttgatcgccacagcagtcctgtgaggtgggcagaagttgttagtcccattttatagatggagagagcaaggctcagagaggttggggatgtccccaacctagaagaggcaataagtgccatgactgcctggggctaccttgggagttccctcatctcttctcctcgataccagcccagaggatgccattccactgaggcaggcatggcttatgagaaagagggagatgaagggaactaggcattttttttttttttttttttgagacggagtcttgctttgtcgctcaggttagagtgcagtggcgcgatctcagctcactgcatcctccgcctcccgggttcaagcgattctcgtgtcttagcctcttgattagctgggattacaggcacgtgctaccacacctggctaatttttttgtatttttaatagagatggggtttcaccatgttggtcaggctggtcttgaactcctgacctcgtgatctacccgcctcagcctcccaaagtgctggaattacagacgtgagccaccgtgcctggcctggaactaggcgtttttaaattaatttttttttgagacgagtcttactctgttgcactggctggagagtgttggctaatttttttgattgattgaggcgggggttcgctctgtcacccaggctggggtacagtgacataatcacggctcattgcagcctcgacctcccaggcccaagcaatcctcccacctcagcttctaaagtagctggtgccacatgtgccaccatgtctggctaatctttttgaaaaatttttgtagagagagtatctcactatgctgcccaggctggttgaacttctgggctcaaatgatcctcccacgtcagcctctcaaagtgctgggattgtaggtatgagccaccattcctgttctttttttttttttccttgttaatttttttgagactgagtcttgctctgtcgtccaggctggagtgcaatggcgtgatcttggcttactgcaaccttcgcctcctgggttccagcaattctctgcctcagcctcctgaggagctgggattacaggcgcctgccaccacgcccggctaatttttgtatttttagtagagacagggtttcaccatgttggcctgactggtcttgaactcctgaccttgtgatctacccacctcagcctcccaaagtgctgggattacaagcgtgagccactgtgcccggcctttttttttttttttttaatttgtagagacagggtcttcctatgttttccaggctggtcttgaactacagggctcaagctatcttctcgccttggcctcccaaagttctgggattacagtcatgagccatggctggcacttcgccttaaaattaatttttaagtaactcggcgtggtggtggggtgcctgtagttgggaggctgagttgggaggattgcttgagcccaggagttcgaggttacagtgagctacgatcacaccactgtactccagtctgggtgacagagtgagaccctgtctcttaaaaaaaaaaaaacacaaaagaaaacacctgggcgtggtggctcacacctgtaatcccagcattttgggagcctggggtgggtggatcacctgatgtcaggagtttgagaccagcctgaccaacatggcgaaaccccgtctctactaaaaatgcaaagatgagctgggtgtggtaacccatacctgtaatcccagctacttgggaggctgaggcaggagaatcacctgaagtggggaggcggaggttgcagtgagccgagatggcgccattgtactccagcctgggcagcaggagcgaaactctgtctcaaaaaaaaaaaaaaaagaatgaaataaaatttatttatttatttatttttgagatggagtttcgctcttgttgcccaggctggagtgcagtggcatgatctcagctcattgcaacctcctcctcctagggacaagcgattttcctgcctcagcctccggagcagctgagattacaggtgcatgctaccacgcctggctgatttttgcatttttagtagagacggggttttgccatgttggtcaggctggtcttgaactcctgacctcaggtgatccacctgcctcgacctcccaaagtgcttggattacaggtgtgagccaccgggcctggcctgagaccttgtctcttaagaataaaataaaatttagtttgaaaatacttttttggctgggtgtggccaggaatttgagaacagcctggccaacatggtgaaaccctgtctaccaaaaaatacaaaaattagccaggtgtcttggtgtgcctgtaatcccagctactcaggaggctgaggcgggagaatcgcttgaacccaggagacggaggttgcagtgagctgagatcgccccactgcaccccagcctgggcgacagagtgagacactgtctcaaaaaaatggcggtggctcacgcctataatcccagcactttgggaggccaagtcgggcggatcacctgaggtcgggagttcaagaccagccttatcaacatggagaaaccccgtctctactaaaaatacaaaattagccgggcatggtggtgcatgcctgtaatctcagctacttgggaggctgaggcaggagaatcacttgaacccggaaggcggaggttgtggtgagccaagatcgtgccattgcactccagcctgggcaacaagagcaaaacttcgtctcaaaaaaaataaataaaaaataaaaagtgaaaacataaaatctttaaaaaaaaaaatcaaagtgatatgtggttgctataaaaatttaaaccatacagaagtgaagtcaaatatttcttcaccaaaatctttgccaaaagaagcatccactcttcccagtttcttgtggcctgtgtgcacatgagaacgcgtgtgtctgttgtgtaggtggggcctggcctggctcttgtggctgcgtatgttgtggtttgtgtcctgagctaggaagcctgactgagggcaggtggggactcaggtctggctaggtcagcccgcgatgcctgctaccatggctcagcctgtgccctcccaatttccatggaagtgctggagggtcttgtggcagcctggggcctggctggtgtgggaaagtctgtttcccacctttagtttggactccgtgtgtgttgttcctcctcatccctctgctcttttctacttagcttattgggttgagccctggagagggaagcaggactctggcgcctttgtttacccccacttgatctctactctagaaagggtctctggtattcttggcctagatttattccaggcaataaatgagagggatgcggtcagatcctcaggtaggccctgtgggctacacaaagtcatcctgggtggcatcccctgcagctcgctcagtgttgcctgaggggatgtggtaggtggcacctctcagggccatggcaaggctcaggtggatgtgaagggctatggtgggggcgagagaggggccggtgcaagtggctacccagagacttttctctaaggtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggtaagctgtcttcttgggggttgggacaggttcccgggaggccaggcccgtgtttctgatggaggagggttcctgggtgggtattgtggtcctgtgctcttgttctgtaacacccagcctcggctccagggctcccagaggcatgcatagtcaggaggaagggtggttccccagggaaggccctgtcttctgtcagcttaaaagaacagatggtgataagggaggcctcagcaagaaatcgggaaccctggagtctagttctcatcctgttcccagctcactgtgtcttcttggttagcctcttctcttcgacttcagtttcttctaacacagaataggcttgagatgtgggatagatgggctttctttaagaagaaaatgatcaaaaatcaggtagtactataatctgctaaaaggtgttttttgtttttctttttcttaaaaggtttaataatgaaaaacatcagtctttgtcaccactctgttaaatgactctactaaaacagactcatctttttgagttctttatctctttaagtgatgtgccatttttcatattgatcctctgctatgggagattagctttcttaggctttcccactccccatatgtccctattgctccaataatgtatgatagttattaaaataataatgtttatggacgggcatggtggctcatgcctgtaatcctagcacgttgggtggctgaggtgggtggatcacttgaggtcaggagttcgagaccagcctggccaacacagtgaagcctcatctctactaaaaatacaaaaaattagcgggatgtgttggtgagcctgtaatcccagctacttgggaggctgaggcagaattgcttgaacccaggaggcagaggttgcagtgagccgagatcatatcactgcactccagcctgggcgacagagcgagactgtctccaaaaaaaaaaaaaaaaatttttttttcccctaaatactgaaagcattccatgatcttttctcctatttttcatctgttttgcttcattttctaggagacttcttatcttctctttttttgaaattattttccctaaaaattttactttctaagggctcctcccttttctggcactctttttttattttttatttattcttttttttgggagaccagagtctcgctctgtcatccaggctggagtgcagtggcgtgatccgggctcactgcaacctctgcctcccaggttgaaacgattctcctggttcagcctcccaagtagctgggactacaggtctgtgccaccatgcctggctaatttttgtatttttagtagagatggaatttcaccatgttggccaggctggtctcgaactcttgacctcctgcccacctcagcctcacaaagtgttgggattacaggcatgagccactatgcccagactctttaaaacagggttctcactctgtcacctaagctggagtgcaggggcataatcatggctcattgcagcttcaccctcctgaactcaagcaatccttctgcctcagccttccaaggacctgggactacaagctcatgccagcatacccagctagttttaaaattttttgtaggggcagggtctccctatgttgcccaggctggtcccaaagtgctgggattacaggcatgagccaccacacctggcctggcaccctattcttattttgtggtttcaatagcttacttctctgtcaatattatattttttttaagaccgaatttcgctcttatcacccaggctggagtgtagtggcatgatctcggctcactgcaacctctgcctcctgggttcaagtgattctcctgcctcagcctcctgagtagctgggattataggcgcccgccaccacacctgactaatttttgtatttttagtagagatggggttttgccatcttggccaggctagtcttgaactcctgacctcaggtgatctgcctgccttgggcctcccgaagtgctgagattacaggtgtgagccaccgcacctggccctaagctggatattgttcccctgttttccatcttatgaaaacttgtaaaaaatctcttactagtggctgtcttctacctgtttctctttgtccttgtgaatttttgccttgctttattttgaatccctttttttgtcatggcagtgtggtcctggcagggagagaaaatgccagatggtgtgttttccccaaagtctgaaatgatcccttttcaaagctcaaacctgaatgtgtcatctttctggggcttcccctgacacttgggttggaaactctggcttctttccccccatggcctgtttggctcacaggtgccaccagcctcaccttgatccactgtcacttgtgcttactcggtgttagctgctttgcctcctttcagtccctcgaaccctgagctcttctcagagctcctagtgctcctctgtcggcctgcagtgcactcccgcttgtgcctattgtgtagctaatgtgttctcatccttcagttctcagtgggggtgctatttcttcagagaagttttctctgttctcccagactgtggttggtctctggtgacctctgtgttgtgcccacacctgtctgcagagtagtgtgtaccccagttgtagctgaagataacattcatctcccctgctagatttaactgtcaatggcagccacttgtcttatttaccagatggatccccagtgcctacaataatgcctggcacacagtgggtgctttttatatgcgagcaaaagaaggagtctcactatagcttggggcaccccagactctggtcttggggagtgggagggctggggaggtgttttgggtcaggttccctggaagcggaacctgtgactcaagagtttcaggtacatgggatctcttggaaaggttctcacctgtgagggaaggagtggagaaaagaagggaaggggccaagcaagggatggggtcttggaaaatagagctttggcctgctataaggccaaggagtgtgtgtgttcacatgtatgcatgcgaggtatgtacatatgaggagggcgcatgtgtacatgggttggggaactcctggggcatcttcggttgtgccttccaagagctgttttttgtttttttttttttgtttgttttttgttttttgagacggagtcttgctctgtcgcccaggctggagtgcagtggcgtgacctcagctcactgcaacctccgcgtcccaggttcaagcgattctcctgcctcagcctcctgagtagctgggattacaggtatgcaccaccacgcctggctaatttttgtatttttggtagagacgggatttcaccatgttggccaggctggtgttgaactcctgaccttaggtgatctgcttccaagggctcttatgcagataaagtcatagtagaagccgtcggcagcatgcccggcagctgggggattggattcgctgtagggacagaggatctgggcaaagcaccaggagcaccccttaccctacacctttgcccagtgagcattgtgtccctgaaggcttagagtgcaaatgatccgaggatattctcttagactgggtgctcagttaagctgttactctctgttcacttttcaaggaaagagtattctgcttggcactccaaagaaggtggtgactactatgtgtcagcacagtacctttgtatttttagtagagatggggtttcactatgttggccaggctggtcttgaactcctgacctcaggtgatccacctgcctcagcctcccaaagtgctgggattacaggcgtgagccaccgcgcctgacctgccgcttgcttctcaccactatacttctatacacttttgtggtactatcccgtccttctgtattactctatgcctttattactacatgtttctctgctactctactctgtgctttatgctactgttctactgtagatgtgtctcctccctgaatcttcagtgagtgatggagtatgacgtagtcttctgaccttccagataaagaaaccaaggcttagggaggtgaacagttctgggccttctgccctctttggccacttatcagtctgtgggaggtgaacaggccttgcatctgaggtcagcgtgagactcagtggaaatgagcagacagtgttgcttatggcttctacacattcgaagtgggcagggaagggggtgagagttccaagcacatatcttcagttttataatttttaaaaaatttaaaattttttttttcatttttatttatttttgagatggagtctcactctgttgcccaggctgtagtgcagtggcgcaatctcggctcatcacaacctccacctcccgggtttaagcgattctcatgcctcagactcccaagtagctgggattacaggtgcctggcatcacgcccagcacctcccaaagtgccaggattacaggcgtgagccactgttcctggtcttatatatacattttttttttttttgaggtggaattttacttttgttcccaggctggagtgcaatggcatcatcttggctaaccacaacctctacctcctgggttcaagcgattctccttcctcagactcccaagtagctgggattacaggcatgtgccaccatgcctggctaattttgtatttttagtagagacagggtttctctgtgttggtcaggctggtctcgaactcccgatctcaggtgatctgctcgcctaggccgcccagagtgctgggatcacaggtgtggtgagccaccgcactcggcaatttttttttttttttaattaaaaaaaattttgttttttacctgaacctgacagtagctggtgccattttataatttttgccatagcctgaatgattcagttgcttatttcacagagcttcgtggaaatgctctgtaaattattagggctagagacttgtgagacttcatcttggaactgaaagagaccttagagttcatctagtggaagattcatttacaggagcaggaacttggcttagggaggttagtgatgtgcctgatggcaccccacccacagagctggggttcaaaggccccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccaggtgagacagctgctcagcctttggcttggtttgatttcacattcatctgacaccatctcattgaacaccttgtccacagctattggtcagtttctgccacagagtctaaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaatttacgtactctaataaacagttttgagttatgacaaagcatacagccatgtaaccactgtcacagtcaaggtatacaacagtcccatcaccccagaattccctcgtgctccttttcttagccttttttcggcccttagctccttgcactgtgatctgttttctgtctctataattttgacttttctagaaattaacaattaaaatcctatagtattacatttgcaggctgttttttttgagacagagttttgctctgatgcccaggctggagttgcagggtgtgatcttggctcactgtaacctctgcctcctgggatcaagcgatctcatgcctcagcaacctgagtagctgagattacaggcatgcaccaccacgcctgactaatttttgcatttttagtagagatggggtttcaccacgttggccaggctgggtttgaattcctagcctgaagagatccgcctgccttggcctcccaaagtgttgggattacagatgtgagccaccatgtctggcactacatttgcagtttttatttatttattttttgagatggagtctctgtcgctcaggctggagtgcagttatatgatagctcactgcaacctccgcctcccaggttaaagcgattctgctaactcagcatcccgagtagctgggattacaggtgcacaccaccatgcctggctaatttttgtattcttagagatgggggtctcaccatgttggtcaaactggtctcaaactcctgacttcaaatgatccacccacctgagcctcccaaagtgctggcattacagacgtgagccagcatgccccagctacatttgcagttttaaaaatgaaatcagtatatacttatgttaacatccactgtcctatataccagagcaaagtttttatttatattttttagctatatctctaaaggttatttttcaaaataaaaatttgggtagggcgtggtggctaacatctgtaatcccagcactttgggaggccaaggcttttggatctcttgagcccaggagtttaagaccagcttgggcaacatggtgaaaccccatttctataaaaaggaaaattagctgtgtgtgattttgtgcacctgtagtcccagctacttgggaggctgaggtggaaggattatttgagcctgggaggtggaagttgcagtgagttgagatcccgccactgcactccagcttttatttataaataaaataaaaatttgaaggccgggcacggtggctcacgcctgtaattgcagcattttgggaggccgaggcgggtggatcacgaggacaggagattgagaccatcctggctaacacggtgaaaccccgtctctactaaaagtacaaaaaattagctgggcgtggtggcgggtgcctgtagtcccagctacccaggaggctgaggcaggagaatggcgtgaacccgggaggcagagcttgcagtgagccgagatcacgccactgcactccagcctgggtgacagagtgagactctgtcacaaaaaaataaaactaaagaaaattaaataaataaataaaaatttgaagcaagcatgacaaaaaatagatttgatgatgccggctgtgtggtaggtaacaattgtcctttgttattttctaatcttttctgtcatggtgtgaactatttaataattttaaaaaatctttttccctcttcttactgggtagagataacttgttgacagttacaattcttccacaatgccctgctagagcgatatattatgtttttgcctctatttcttgaattttcaattttagagaatatctctcgattgcccaatatgaatgcacctatggggtaactttcaaagggcagagaaatgtatcaaatgaaaagtaaaacgacttctttttctggtttcaactccctgtgcatctcttaaccggaggagtctacttctgacaatttcttgtacatctaagtagtatgtgtttgatcttttacttctgattgaagaaaaggtctccgttccacaaagagaaacagcgggcatcagccgactcatagaagactttcagcataggacagagtgaacagatctctagtctcttaaaaactctactgtgctgaaagccagttattgacttggcttttgtcccctgacactttgagtgtctggagtgctggctgtgctgggctgggaccaagccccagaccatgaccctgagcacaggaggtcaatttttttttttttttggagacagagtcttgctcttgcccaggctggagtgcagtggtgccatctctgcttgctgcaacctccacctcccaagttcaagtggttctcctgcctcagcctcctgagtagctgggaaactgggattataggcattcgccaccatcctggcaaatttttgtatttttagtagagatggggttttgccattttggccaggctggtcttgaactcctgacctcaggtgatccacctgcctcagcctctcaaagtgctaggattgcaggcatgagccaccatgccgggcctgtgttgatttcagccttacccgtgtctctccaatgtggtctttctggtgtgctatttatttaactagtttcttactgatgtagataagggtattactggttttttgttattagagataaaactcttaacagtcacccttgtggccaaatgactgcttctttgtgcagttatttcttgagaaattcctagagatggacaaatatatttggtggtggggggaacccttttggctgagtatggtggctcattcctgtaatcccagcactttgtgaggccaagttgggaggattccttgaggccaggagtttgtgaccagtctgggcaacatagggagactgtctttacaaaaaaaaaaaaaagctggtgcggtggcacacacctgtagttccaactactttggagcctggggcaggaagttcacttgagcccagtatttcaacagagtgagactctgtctttgaaaaagcaaacaggccaggcgtcatggcttacacctgtaatctcagcactttgggaggctgaggtgggcgtggtgacacaggcttgtaatcccagctactcgggaggctgaggcacgataattgagaatccacttgaactggcgtggcggaggttgcagtgagccgagttcgcactgctgcactccagccttgggtgacagcaagactctgtcttaaaaagaaaagaaaaaaaacctcttaatacattttgttagattgctgccagaagaattttgcatgttaattcgtgtatgggaccactcccaacttctccactcactggtcagtgcttgctattataaaattgtttcctctgcttcagaagtaatgcgtgatcattgcaaaaacttaacaactttatagaattgggcaatgcagaaggttgagcctgctcatctcaacttttttttttttttgagacggagttttgctcttgttgcccaggctggagtgcagtggtatgatcttggctcaccgcaacctccgcctcccgggttcaagcgattctcctgcctcagcctgccgagtagctgggattacaagcatgtgccaccatgcctggctaattggggtttctccatgttggtcaggctggtctcaaactcctgacctcaggtgatctgcccaccttggcctcccaaaatactgggattacaggcgtgagccaccacaccaggcttaaaattagacgatgtcttactcttttacaactttctttttctatttaacatatcgttccatgttgttatgtgtattcagatctccaacattcctgaatttgccgtatcttatttaaccattatattgtcaaacatctgttactatttccatcaatgctataatgatcatcattgttcagtttctttgtacatttgctgaactgtgtggttgatttttttgtttttagatggggtctcactctgttgccaggctggagtgcagtggtgtgaccttggctcactgcaacctccgcctcccgggttgaagtgattctcctgcctcagcctcctgagtagctgggattacaggcatgcagcaccatgcccagctaatttttgtatttttagtagagatggggtttcaccatgttggccaggatggtctcgatttcttgacctcgtgatctccccgcctcagtctcccaaagtgctgggattacaggcgtgagccactgcgcccggccggttgattttatagatgtggaatgattgggtaaaatagtgtggacatttgaagttttcataagcattgccgaattgctgccaaagggattgtactgtttaatcctgctataggtggtatataggactgcttgtttccagccttattgtcaataccggctatggttatatgaaaaaaaatctttgccagttttaatgagcaacaaatgcattatcatgttcttattttgattgaattactttggagttgatcttttttttttcagctttattaaaatataattgacaaataaattgcatatattgaccaggggcggtggctcatgcctgtattcccagcactttgggaggctgaagtgggcggatcacttgaggctaggagtttgaggccagcctggccaatacggtgaaaccccatctctactaaaaatataaaaaattaaccgggtgtggtggtgcacgcctgtagtcccagctgctcaggaggctgaggcatgagaatcacctgaacctgggaggtggaggttgcagtgagctgagagtgtgcctctgcacgccagcctgggtaacagcaagactctgtctcaaaaaacaacaagggctgggcgcaatggctcacgcctgtaatcccagcactttgggaggctgaggcaggcggatcacgaggtcaggagatggagaccatcctggctagcatggtgaaaccccatctctactaaaaatacaaaaaagaacccaaaaaattaaccggtcatggtggcgggcacctgtagtcccagctactagggaggctgaggcaggagaatggcgtgaacctgggaggtggagcttgcagtgagccgagatcgcgccactgcatttcagcctgggcaacagagtgagactccatctcaaaaaaaaaaaaaaaaaattgcgtgtatttatggtgtgcaatgtgatgttttgattcattgttttggttttcatttcttttactattaatgagggtgagtaacaaattaccccttaatttgttaatttgttatttggcttggttgtctttttttttttttttttttatcttgttactggtttgtacattttatttgtatattaaggatgctactcctttatcatgtagtaactattttttcccagtttggtagctttttttctttattttataaaggtataatttacatacaataaaattcactttttgtttgttcgtttgttttatagagatggggtttgcccaggctggtctcgaactcctgggctcaagggatctgtctgccttggcctcccaaagtgttgggattacaggtgtgagccaccacgccccgcatattttttttttttttttttttttttttttttttttttttttttttgagacagagtctcgttctgtagcccaggctggagtgcagtggcgcagtctcggctcactgcaagctccatcttccgggttcacaccattctcctgcctcagcctctcaagtagctggaactacaggcgcctgccaccacacctggctaattttttgtatttttagtagagatggggtttcaccgtgttagccaggatggtctcgatcctcctgaccttgtgatccgcccgtctcggcctcccaatgtgctgggattacaggcgtgattttttttttttttttttttttaaatgagcagggtcttgctctgtaccccagactgtagtgcagtggcgtgatcatagctcactgcaaccttgaactcatgaactcaaggggtcctcttgcctgagcttttcagagttctgggattacaggtgtgagccgccacacccagccccctcccccctcccttttttttttattagagtcttgttgtgttgcccaggctggagtgcagtggtgtgatcatagcccattgcaaccttgaattcaggaactcaagggacccaattgcctcagcctcccaaagtgctagagttacaggcataagccactgtacctggtctttttattttttaatgtttattaagcattaaaaatttattttttaatttttttgagacagagttttgctcttgttacctaggctgtagtgcaatggtgcgatctcagctcactgcaacctctgcctcccaggttcaagcaattctcctgcctcagcctcccgagtagctaggattacaggtgcctgccaccacacctggctaattttgttttgttttgtttttagtagagacagggtttcaccatgttggccaggctgatctcgaactcttgacctcaggtgatccaccagcctcgacctcccaaagtgttgggattacaggcgtgagcctctgcacccaacctctgtgtattacttctttcatctgagccatttgagagttagttatgtagcatagattcctaagaataaggccatttgcttacataaccacaataaagttatattcaatccagggaatttaagcctaattcaggatctttatctacagtttatattccatttttccctgtccatgatgcagtctaagaccagacattgcatttagttgtcctatccctttagtcagcctttcttagtgtcatgatgttgacattttggaagtatatggtatggctaattattctgtagaatgtttctctatttgggttcatcacagtttccttcttagattcaggttgtgtggtttagctggaaactactatatagtctatatctcagcgaaatgcaaatggtgtattcttgtgtcttacagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggtatgttggtcacaacacttcacagtgagcacagaacacccccagcaggaagtgcttctctctcaggcccacatccttttgctcattccatcgccctgctaacagttactgacttgatgctgaatgcctagccctgacccaagggctggggacaccagggttgtcagcatgcagtccctatccttggggagctcccggtgtgtgcagcaggagtttgtggtggcatctgacctctatgtatggcacagggcggggtgggaaggctgcccagaggaggtggcactgaactgagtcctaaaggttgactggcaggtgacagcacaggacagcgtggtatttgtggcatcacacatggttgggtctccctgaagaggagcccaggaaatgccaagtcttggtgctggtcttggagtggtgagtgggttctggttactcagggtggggcagccattgagcccgtgttgtggttactgtgttggctgtgtggttgtgtcctttgaggagggcttcttggtgtgacaccccggctcctggctgcatcggccaggcctgctgtgtagagcgggttttgggaggtgaaagaccagaggcctggtcactagggtggggagttcagtatgggggtccgtgttcgcctttccacccaggtgtctcccatcctagaacatctaactgccagggtctgagcttaacatacagtctgcgtggtatcctgtgaggtgtgtcatttctgttttttaggtgaaactgaggctcagagaggtcaagtagtgtacccaaggttgcacagcaagtatacttggtggtcttgactgccatgctatgctcctgctactatcgcttggcaggcacagctcgcttgtattgagcacccactgattgccggagccagtgcttaatgagtaattacagtacctaacattggagtgcttgccgcgtgccaggcccatcacttgctacctaatgtgtaggctcttagttggtctttaacagcctgtgaggtgggtagtggactcatcaacagtgagagcaccccacgctcagagaggttaggagacttggccaggttcacacagccggtgacctccaggaacaggagttaaaccttgctgtccggctcagagctcaggctctttccacaatgaccttcagcgcctgttgggggagttactgcgtgtgtggaaatcccatcttccctcctctgctccgtccacttcagtggtccttgtaggatgtacttctggtctaccagacactgtcggtgctgggtcctccctgaattggggtgtgggcctgaggtcggtcctgccccccagctggcctccacccttaggagtgaactaccccagggaaccagaactcggctttagtgtctgggtccactcagaagccagaacccaaagaccaaagtggaagcctctgtgtccagaagccttttggtttgtgttgtgatttattgggtaaaggagggaaaacctgtagtgactcacgggcttgttctagaagctgagtgagtaactttgggaagaccgaatccccttagctcagcttccttggtatgaaagggaaagtaatgcttccctagcagaattgtggggattggaaataacttttgtgagctgccccaaggaggcatcaatgatgagtgacatcccattcactgctctatatttcgttctataaaaatatctgcaggctgggtactgtggttcatgtctgtaatcccagcactttgggaggctgaggtgagaggatcacgtgagcccaggaatttgagaccagcctgggtaacacagtgaaacacagtctctataaaaaatattttaaaaaattagctgaagccgggtgcagtggctcacacctgtcatcccagcacttttggaggccaaggtggtcagatcacctgaggtcaggagttcgagaccagcctggccaatatgggtgtggtggcacacgcctgtagtcccagctactcaggaggctgaggcaggagaattgcttgaacccggaaggcggaggttgcagtgagccgaggttgcaccactgcactacagcctgggcgacagagcaagtctctgtctcaaaaaaaagtaaaaaataaaaaattagccgagaatggtggtacatgtctgtagtcccaactactcgggaggctgaggcgggaggatcacttgaacccaggagttcaagcctgcagtgagctgtgattgtgctactgtactccagcgtaggcaacagagtgaaaccctgtctctttaaagaaaagaagaatctatgaaaatatagatgtatagtcatagaaaactttgaggaaatgcatgaaatattaatgattggtcctgggctgtgggatcatacttgacacttaaatatttcccgtaatgaatgagtcctcttgtattaagagcatagtaattgcaattcctaacctccctccctggacaggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccaggtgcgtggaccccactctggctgcttattgggtcggtacagacacctagtgttcagtgctggggcaagggtgagcaaaacgagacctggctctgccctcatgcagcttatgctctggtaggaagaccaggtaactaaaaaagactcagaaaatgtgataatcaggatgaaagagaaggcttatggtgctgcatatgtgtatctagtctgggcaagtccaggaagactgccaggaggagaaggaggatgctggtaactgggtaatgaaggagaggaagagaactgtcgtgtttgttcagtccacgtatggaacctatttcacagcagacttaccagcactggggagcaaagatgaagatgatgggttgtctccagcactggctggccctgcctggtcctgggaagacctgggatagccagtgctggggatgggcttgtaatgaattaaccagaatagagtgtgggaagtgccatgtgatagcaattgcgaagtcactgagaactcactgttctgggtgttgcccctgggtgctctgttagtaacacacagagcctcgggagccgggatgggtgccagggtctctctgagatagaggtcatggggggcacctggccttcctgcagagaggtgtctgggctgggtctccttgagcaccttgaccaaaggcacagaaaaggaaggacagagtggatgtgtggagtggtggggggtggcgcagggccttggtgggcctaggtataacttagggctttggctctcattaggtttgttcttcctgtgaggctgtgggagagagcgaggccctgaggtggcctggtgcaggaggccaccctgtcatcacgggtcaggatggctagtggcattttgagagagaccctgtgtcggtttgctccggctgcttaacagagtaccacaggctcggtggatttgacaagaaattcagcagtgttggtttctactgaggcctctctccttggcttgtagatgctggcggctcctgtgtcttcacgtggtcacctgtgtcctaatctattattttttcttgtaaaacctcttattttataatgttataaggacacccgttattggattagggcccactctaatgactttattttttgagagtcgctctgttgcccaggctggaggctggaggctggagtgcagtggcatgatcacagctcactgcaatctccaccttccaggttcaaggaattttcctgcctcaggctcctgagcagctgagattataggcatgagccaccatgcccggctattttttttgtatttttagtagagacagggtttctccaggttggccagactggtctcgaactcttgacctcaagtgatccacctgcctcggcctcccaaagtgctgggattacaggcgtgagccaccgcgcctggcctaactaaccactttaaaggccctatctccaagtattaatacagtcccattctgaggtgctgagagttgggacttcaggatgtaaatttgggggagacacaggtcagcctgtaacatgccgcaagtgagggctgctggctggagaaggaaggcagcgggtccctcagctactatttgggaagctcaggatgatggagcgtggtcgctctactccagagaccccatttagggtggtgaccctgagggttgcagatggctctctattatagcaccttcagggcagggagggaagagagcggggtgcttcaaaggatggatgttggcttagatctagatttcattctcacttctagcactcagtgcaagactcaaaacctctctaagcgttggttttcttatctgtaaaagggggatagtaatagtgcctatgtctcaggatttgtggtaactaattgaaattatttgtgtgaagtgcttagcactggcaagagaaggtgccctctaaatgataaccccaccgccaccagcacactacaactgtcacatgccttttgccttcacaggtcagttcagagctagttttatttcttctgagaaggagccactctcccacagttggcttcctgtgccttaactgcgtcgtcagcactcgagtagagatggcaaaagctaggattagggtgacggaagcccagaggtctgtgtgaacctgcttggtgggctcctggcatcgatctgtcccagtccttgttctcgggtgtctgatgggtcaagaggggacctcagtatcagagcagacgttttgggggagaggctcaaggatctctccccatgatcccctgaggtctcagggatactcatgcaggtcatcattttgtcttgttccctctctcttctttggcagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttatcgatatagttttgggctccacctttgcttttcctcatttgtattttttaatttgatagtttccttttttgtgatcctcctgcctcagcctcctgagtagctgggactccaggtgcatgccaccatgctcagctaattaaaaaaatatttatttatttatttatttatttatttatttatttatttattttgagatggagtcttgctctgttgcccaggctggagtgcaatggcgcgatcttggctcactgcaagctccgcctcccaggttcatgccattctcctgcctcagcctcccgagtagctaggactacaggcatccgccaccgcgctcagctaattttttgtatttttagtagagacaggatttcaccgtattagccaggatggtgtcgatctcctgacctcgtgatcctcctgcctcagcctcccaaaatgctgggattacaggcgtgagccaccacacccggctaaaatttttttaagaggtgaggtcttgctactttatctgggctggtcttgaactggccttaaagtgatcttcctgccacagcctcccaaaacgctgggattacaggcgtgagctactgcacctggccctcatttgataattttctgtctcaggaatggagagtccaaattagcctgaaaaacataatctcttccgcttcctaaggtttcaggtgcaaattcgttgtgtttgagcagccttatgtgcagggcgaaagtgcccatccctctatcaagagtggagactgcattcctgtcctctgagcttacggagcatgacattttctgtctggaagcctgtacaggttgctcgccagcctgcttttacaatggaagtgcttttacaataagtttacttccttgggtcatcatgattctaaattccaggtagagagagttgcttaactattcctctgcttgatacatttgctggaggaggaaatcgctattttgtgattcagaaatcagctcaggaattttagccctgatagtgatacataatttcgggaaaagatttgtgaatcccttagtcagaaatcagtctccaaagtccggctcagtggctcacacttgtaatcccagcgcttgggaggccaaggtgggaggatcacttgagactaggggtttaagaccagtctgggcaatatagggagaccctgtctgtacacaaaaaaaaaaaaagttttttttttttttgagatggagtcttgctttatcacccaggctggagtgcagtggtgcaatctcggctcactgcaacctccgcctcccgggttcaagcagttctcctgcctcagcctcctgagtagctgggattacaggcacgcgccaccacacccagctaatttttgtatttttagtagaaacgaggtttcaccgtgttggtcaggctggtctcaaactcctgaccttgtgatccactcgcctcggcttcccaaagtgctgggattatatgtgtgagccactgctcccagccaaaaaaaatttttttaattagctgggcgtggccgtgtgtgcctgtagtcccagctactcgggaggctgaagtgggaggattgcttgagcccaggagtttgaagctgcagtgagctatgattggctactgcactccagcctaggtgacaaagcgtgactctctttctagttttttttttttttaaaaaaaaaagagaaaaaagaaatcagtctctaaagagttgatctaaagcataacttagataggtttcgtgagaaatgattgtccgttcaaaccagaatcttggacttcgcatctaagcccttaaacagagatgctgtcactacaaaaggcattgatacttctctctctccctttctttcttatccatgtggcctcatttgctgcctccttccaattccttttttccataggaagaagcatctccagtgctcttcattcctctttagatccatatttccatctggttccttctgaaggccatcctttaaccatgtagtgtgggcttgctggtgatgagttctaatttttatatttttttgctaatttttctatttttttgtagagatggggtttcgccatattggccaggctggtctcgaactcctgactcaaatggcctgcctcggcctcccaaagtgctgggattacaggcgtgagctgtaatccagctgttattcctttgtagagagtctctttagttatccctcaaatttgacaggctgtatggtggtgtggtatttctctatttttttcccccccggctttcatatcagactaaagattcaaaccttgagctgaggaagtgtttatttctttagtttttctttccctgtctgccccttctcctaccttaggaattccttcatatataggctggattggtctctgtgtctttttcgtcttcatacgcctcttcaccatcttaagccatttccttaatcttcggagaacatgatgggattgttttctgattcaccagtttggttgtctgtggtttccaacttgctgaattctctgatttacagagctgcattttttatctccaagcaatcttttgaattcccttttcaagtcagcctccctgcctccctgagttttctttttgagacagtcttgctctgtccccaaggttgaatacagtggtgtgatcatggcccactgcaacttctacctcccaggatcaagtgatcctcccacctcagccttctaactagctgagaacacaggtgtgcaccaccatgcttggctaatttttttgtttttttgagagacagggtctcactgtgttgcccaggctagtcttgaactctgggactcaagcaatccttccgcctcagcctcctaaagtgctggcattacaggggtgagccacaaggcccggcctctccctgagttttctaatgtgtgtatatacactcttttttttcttttttccgagacaaggtctctcttagtcacccgggttggagtgcagtggtgcaatcatggctcactgcagccttgaattctgggctcaagtggtcctcctaccatagcctctggagtagttgggactacaagcaccaccatggctggctgatttttttatttttagtagtgatggagtctgtgttacccagactgttctttaactcctggcctcaagtgatcctctcctgtcagcctaacactaatcccagagtgttaggattacaggcgtgaaccactgcctttggccatgtgtgtgctcttagtccttgttgatgccacgaattagagaggttctggaattttctcatgttcctcagaaactccatgtcccatggagatgcttgagtggctcagattcacctctgtgaattgtggtttgaactgtaagatgtgtacatttgacttgtgcttatctgtcttcactcttccttacagagggggatctctgtgtgtcccagatgggggataacaagggtttgggaagagactgtggatccctgcctaatctctaggtcctgaggaaggaagaaaagaatggtctgcatttgttctagttttttatctccccatggagtggctggccagctgcgggaagtggaggcggcgaggccccaggctgctgtttctaggagttggcctcatcacccaggtccctggctacctggggtgtttctctcatcctctgagtgccctggttatgccatgagagtcagccatggtggtatctccaggtgactaaggtcacataccagcacacaagggttcgtgtttgtggaacctggtagcttccttcagagctgacatttgcccacagccagcctggcccagccccataccaccagccctggcgctctggggcgtgaggtgccttttctgcccccctgctctagggcaggtggaaatcacccatggtgggtctacatctgatagaagcatcttatagttctgcttctggaccagaccatcctgggtttttctctgttctgctgaagggttccctccacgtgtccatcacctcggtgaactcttgggagacctgggaagatgctggcctcacctctcgcccctcctttccctcattgtgctgccaccatccttctcacacaggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcaggtttgtaaccccagatcagaagtactccatggacaacactccccacacgccaaccccgttcaagaacgccctggagaagtacggacccctgaagcccctggtacgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctggggtgagtagggtaggggtgggagagcctgggcagggggaattggagccgtggcatgggggaggcgtctggggacaggttgtagaaagtgaggcgctggggagaatgggggcgtagcatatcccctttgccccctttcgcacggtggttgttgaggaaactgacaagataaggacagtgtctctgggaccctcctctgctctgctttgaaggattcacttacttatccagcattgtgttcggaccctgctcaagttgggctgggctggatgtggtggatggagcagcaattacgacccagactggatctccccttagtgttcagggggcagagacagatgctagacagacacaccatgactgaattcacagggtaccaagggccgcagaaagggaggttccaaaggaatcttttgggtggaggcgaggcggtcgggatgagccagccaggccaggcagtgcctggctgagtgtcaagctgcatgagctgggggtgggggagtgggttcaggtgaggtggagtctgcaggggctcctgggcaggggggcagggaagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctagctgcggcggagccccatcaagaaagtccggaagtctctggctcttgacattgtggatgaggatgtgaagctgatgatgtccacactgcccaagtctctatccttggtaaggcttctgctccttggaactgttgagttttggagaggaccctcaaggtggagttagtgtagtgactctccaactgggcttctggaaccctgggctctgcagggaggggctatcagggagggtgggtccgggcacccactcatggcttcagtcagcagctctgcttgtctctcacagaaggttttgtttggcagagttgcgcggctaggacatgttttaaaaacatgcatctgggtctcctgcgctctcccagagagggtcagtgatgtgtctttttttttctttttttttttttgaattggaatttcgctcttgttgcccaggctggagtgcaatggtgccatctcggctcactgcaacctccgtctcccgagttcaagttgttctcctgcctcagcctcccaagtagctgggattacaggcatgcatcaccacgcccggctaattttgtatctttagtagagacggggtttctccatgttggtcaggctggtctcgaactccccacctcaggtgatctgcctgcctcggcctcccagagtgctgggattacaggcgtgagtcaccgtgcccagcctagtaatgtgtcttaaggtatagccaggcacttgggcacattagtcctgggatgggtgctatacagcccccaggccagtggacttgctgtgccgggtgctacagtgaggtcgacctcagaaagggggttgttgcctgtgcagagcctgggtccccagaagccagggtgtgctgctgatccctctctgctcacaatggggtgagttggcttgccctggctcagagtggggaggcggtgagaggcatggcggcgtcatgaacaaaggttaagggttgcctgatcttccaagtagactgctgccctcacggtccttgcagagaaaccttgtcctggctaggggtctctgacaggctggggacctgcagccaggttactgcaaagaaaaaaacatcaccgcagggagtgaagagcacagattgagtcaggtgggcctgggtttgagttatgacaccatcactgctctctgggatctttcaggttccctgagccccagttaaaagcctataaaaggggtgccaagcctaagtcaggagggcacagtgccaagcagagcagagagactggaagggcgtgggaggggctttgtgcaactccgctgtgcttggggttgaagctgcgtctttatgatgcttgtggatgtttctggtcccaggaaaactaggaacagccttggctcctcctgaggctttatgtgacaaagccaacgttattgagtatgttattactggataatgctcagtgatactccacatttattgattatgttattatggcctgggggctgcacggcacccatcccagggctgatgtgcccccacgtacttgactgtgcctccagacacaccactgaatcaggctctgaaacgcacacacgtttctttacttgattacttgattttttttttttaagtaagaaagttctttagaacaagattaagttctttgcttaatttttttttgagacggagtctggctctgtctcccaggctggaatgcagtggtgcaatctcggctcactgcaagctccacctcctcccaggttcgcaccattcttctgcctcagcctcccaagtagctgggacaacaggcgcccaccaccacacccagctaatttttgtgtttttagtagagacggggtttcaccctgttgaccaggatggtctcgatctcttgacctcgtgatccgcctgcctcggcctcccaaagtgctgggattacaggcgtgagccaccgctcctggccctttgcttaatcttttaagtataaagtaagcttaagctcatgtaaactccctatctgaaagcagaaactgaggcttggaaaagtgtgtatcctctttcaggtctcagcagccaggtggtggtgctggggtgggattgcgggtttttttcttccctctcacagcttctcgcaaaatggtgactccttgacttggttttggtttcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctgtgagtgctgtggccatctctgggggtcctgcagtgcccgccttcttagctcagggctgagtgctggccatccctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgcctcctggctgtggcttctcctcgaggctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccctcttgcctcctcccagatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggactctgcctctctactgggccctgctcatggttccctggtgacctaggggcctcttctgggatatagggacctgaatgctcatcctcagaggccagccttatcggcacagcccaggcctgagcccttgaccctgtttccacagaggggcacaatgagatgagagcaatttctctcgtctctgcacccagtgggcatctctgcaaagctctgagtattaatagccatggggttgggcgggggtgggcagagactgggggcggaggaggacgatgggttggtgcagtagggccttgcctggcccttgccttgggtggctcacctgcccattaacaagcccctgcctcaagctgagcgtggcccccaggtcagaccagtaagcaaggaagaggggtgaaggcagctgggcagaaccctctagccccattggccaaggctgagcaggaggccaggatgggccagagcctctgcccttgtggccctaaatccctagggttgtggctacagagcacagtgcttggcaggtggttgggaagagtcactggggattgaagaggggaagatgccaagtctgagaatgtctaaatgaggaattgatgttttcagcagcaggcttcatgggacaggcacatgaacatccctgtgggcagaggttgagcagacttggggcaggtcctcacctggggcaagagatgcggccaactctagagggatggggactgagttaattagggtgccagagttcagatgtgtctggcctcagacacacccctttctccctgctgagctcccgcctacagtccccctactcctgtccattcacatgcaggcatgccgtgcttggtcctggcagtgtcccagttcttgatctaaagccgaggaggggcgggggctctgtgcttcccaccctgcaccccgcaccccgcagcccatgtggctgggctgcatgcacctgcaggttccatggatgaaccacacctaactcacgccctgagcttttgtgatttgtcagcatggagcctatcccctccccaacttcttccccaaggtctgtcactggccgctccctacagtccttggtcacccaaggtggatgacctgtgccccacggtgaggatggaggctgcattaccttgtctcctatagctcacaccaagactcggtggaacaactttgtcaaactcaaatgcagtgcgctgcaggctaatgatgaaaattcctgggccctctgagtcaggtacctggggtggagcctgcaaaaagggatttttaacaaaccaccagtgggttattcacatgcagggcgttgactggctacactctgagctgacgcctgtgaggctccaggggcttgtaccccatgccctctcttgcctgaggtcttgctcattcccagggactgccctcaggccctttcctgtcctggagggaggaggctgtaaagaacagagtggctgcaggtaacagcaagcttaacataccatcctcactgagctctgtgtgctgtgggcttgttctttggttcatgcattaaataaatactaggccgggtatggtggctcacgcctgtaatcccaacactttgggaggccgaggaggccaaattgcttgagtctaggagtttgagataagcttgggcagcatcatgaaaccctctgtctactaaaaaaaaaatagaaaaaattagctgggcatggtggcatgtgcctttagtcccagctcctcgagaggctgaggtgggagaatcacctgagcccaggaggtcgaggctgcagtgagctgagatcattccactgcactccagcctgggcaaccagagggagacactgtctcaaaaacaaaaacaaaaccacatttattgagggaccctccaaccctacccccacatgtctggcatagttgtagtgctgaagatatagcagtaaaggatagaaaccaggccaggtgtggtggctcatgcctgtaatttagtactttaggaggctgaggtgggaggatcacttgagcccaggagtttgagaccagcctgggcaacatggtgaaaccccatctctacaaaaaattttaaaaacttagcatgatagcatgatggctcatgcctgtagtcccagctactcaggaagctgaggtgggaggatctcttgagctgtggttgtgcctctctactccggcctgagtgacaaagcaagaccctatctcaaaagacaaaaaccaaaaaactaccttattctcatggagcttaaattcttttttttttttttttttttgagatggagtcttgctctgttgcccaggctggagtgcagtggtgcgatcttggctcattgcatgcttcgcttcctgggttcacaccattctcctgcctcagcctcccgagtagctgggactacaggcacccaccaccatgcccggctaattttttttttgcatttttagtagagacaaggtttcaccgtgttagccaggatggtctcgatctcctgaccttgtgatccgcgtgcctcagccttcgaaagtgctggaattacaggcgtgagccactgcgcccggccatggagcttaaattctaaaaagcagacagatataaaccaaccaattgatataaaatgtgccagagggaactttgaagtaaagcagggggtaccgtgaggccagtcatctgctcagagaaagtggggaggagtcagatttgacagctcctggccatcatggggacagggagagcccacatgggaaggcagattggttgccactcaggaggtgctgggggcccagctgctgtttgatcaggagtttggggaacttggtcatgaggattgatccaggcctgatgtttcccaggctagtgtggcaagcaagaaagagttagccagatagcgctgaggggcagagggcctgagttcaggatggtagtacaggagtgggggtgctgcggtcagcctgggagagggacaggcaggagggaaagatgaggcttagttaagatggcagagggaggctgggcgtggtggctcatgtctgtaatcccagcactttgggaggccgaggcaggcagatcatctgaggtcgggagtttgagaccagcctgaccaacatggaaaaactccgtctctactaaaaatacaaaattagccgggcatggtggcgcatgcctgtaatcccagctactttggaggctgaggcagaagaatcgcttgaacccaggaggcggaggttgcggtgagccaagatcgcaccattgcacttactctagcctgggcaacaagagcaaaactatcttggaaaaaaaaaatggcagagggtgaatctgccattctggcaagatccagatgattgtctggcatttggtgaccagcatggcctggaggtgagaggctcacagatatagaggctgtggtagattgttccagcaatggctccctagggatcactgctccctgtagctattcccatgagtgggtcatgtggttgactttgcccctgagggactctgggagaatctgctgaaggaggtgagaattctagctgttctggttgagactccagacgtgagtaaggccaccctaaaccatccagcctcacctgatctggcccagactggaggaactgcccatctgatcacaaagtcatgagaataataaatcagtattgctttaagccctaagattgaggatggtttgttacacagcagaagctgactgatagagatgctggcatgaggaactgggacatgtgagtacttaaggtggtccaggataaagataaaatgtccttctcagagcaaggcagggactggggcaggagcagttttgataggccaggagtagtttgggagtcttaattagccactttttcagcagaccctggtgtatcactgaggaaaatcaacactgagccatgggctcatcagggttggggagaaacaggagacctagggttccaggaactttgcgggaaatgaatggggtgaaggattctggagttcaaagccactgtgaccatacctgtgtcttgttccccagagctgaaggcagtggggagagatatggctcatggcatctggcagactctcccaggtcctcctgcagtcctgggtagagctcttactttggatcagacagacttgggtgtaaacccagcttagctcttgggagctgtgtgtctcttcaatgcactgagccttggctccttggctgtaaaatagggagaatccttcaacttcagacttgttgaagggattgggaagaatatggcacatacttggtgctcagataacatgggctcttagtatgttattacttagtatgtttttacatgtttctcatttctttgttacacacaatataccctgcaaaggagaaattagtgcccacgtttcaggtgagtgctgggagggaagatggtagacagtggttgagtcaggacttgagcccaatcctggacagcaagtctggcattttagtatgccccattccatgccatcctctgtgtcatactgttatgggctctttgggttgtcacttttctggccagaaacatctgtggctgatggcacctttacccgagttcttgtcctgtgtccaggaggtacgcagacaggtggaaggtgaacatgattaagagaaactttattgagtgttacaacagttcacaggagaccctcagtgagtaacttctgtctgtaggcagatggtctgcagtgttaactctcagcggagaggaggccctggaggatgttgctcctctctgctactgtttgtcccattatctccagttaccagcagagacagtagctcctctctgcagctggtcatccctttctctgtcctctctcctgctctggctgagcccgggacttttatagacctcagagggggtgaagtgcatgctgattgctctgtgggtggccatgggcagcagggagggagcaccacaagtccccactccggccctcaggactggcagctggctcccagccttcaggccctccctggcctgaaggaggggccttactggggactcgcccccttctgcccaggaatctgactcccgctgccattcatggcccctggggtgcagccccaaccctgctcccagattggagcaggtgcctggagaggagatagtccaggcagcgggagcagacacccctgagcctgcagggatggggagcattccccgcctgagaatgcaggctgcagagatacccaggtcctgcacttgggagggccgctgcagctgcacccagggagcttccgccccgccaacttggaaggggtggggatcctgcttgtccccagctcctgcctagtttgtggagcaggaggcccaggtctgcagccgccagtcgggtggctgcagctgcacccagacaggcagatcttgcctgctcccagccccgctaagagcacgggaaggcttggatccacagctgcagtttgggcagctgcagccctgtccagtagggcagggttcctgcctgctctgtggagctggaggcctgggttggcagctgagatttgggcagctgcagcggcccctggggagcaccagatccatggagtgtgcagctcccgctgcgcttccctgccacaggtgcctccctgctgcagcccatgtgatggcagcagccaatgacaatacctgtcagccagggtaggagtatggtgccatagaagaaaaccgtaagcgttagatagaggttcagttaaaatctttccatcggagtgcaatattcatacagaagagtgcatgaatcccacgtggctgtggatatgttttcacaaagtgaacagactcgcataaccagcacccagatcaaacaacagaacaagagcagcactggaaaccccctctccacccacgaagggtaaccgccatcctaacatcaaacaccagctttgctttgcctttttattttcgttaaatattatgtcaacagaatttcacattatgtgagattcatccaagtagatctgggtagttatcatttgttcattctcatgaccattttgttttattttctattttattttctatattttattttattttatacatggtcttattctgtcatctaggctgaagtgtagtgatatgattttctcactgcagccttgaaatcctgggctcaagggatcctcccacctcaggcgtcccgaataactgagactgcaggtgcaccaccacgctcggctaatttttttaaatgtttttatagagacatggtctcactatgttgcccaggctggtcttgaactcatgggctcaagtgatcctcctgcctcagcctcccaaagtggggctgggatgaattagaggcatgagccaccacacctggccaatttaattttaattgacaaataattgtatatgtttatggggtatgatgtgatgttttgatatgtttatacatacacagtagaatgattaaaccaagctaattcacatatctatcacctcacgtgctttttttgtgtgttgagaccatttaaagtctactcttctcaattttgaaatttacaatattggtttttcgttgtgtgacttccacaatttacccattatctcaaaggatgtgtggattgcttccagactgactattacacatagtgctgttagcacctctgcctcgccaccccacagtctgggaagtaagaagcacctctccctggctgccacaccatctgggaagtgaggagcagctttgcccagctgctgtgccaccctccaagtgtgaagtggtagccttgtgtgtgatctgtctgccctctccacgtctgcattttcgaaattaaagtttacttttaaattaaaaaaaaatagtgctgttatgcacatgtcatcctcatgttttggtgaactgtcatgcacatctggtttatacatatctaggagtggaactgctggggatggattcaattaggccacttgccatgcactaactttgtgaaccaaggcacattatttaggttttttttttttttttttttgagacggagttctgctctattgcccaggctggggtgcagtggtgcaatctcggctcactacaacctctgcctcctgggttcaagtgattctcttgcctcagcctcccgaggagctgggattacaggcacacaccaccatgcccagataatttttttgtatttttagtagagactgggtttcgccatgttggccttgaactcctgaccttaagtgatctgcccaccttggcctcctcaagtgctggaattacaggtgtgagccaccacacccggctgtcatttagcttttctgaaactcacttttcatatctgtatattggagataaaaatacttgctcctcagttttgtggcctggatttaatggaattatttcagcaaggcacctgacctgaatatagttcctctctcttcttcctctgccagccagagcaccctctgccccaagacacagcttttccaccgcactctctttgccaggaaccctcagcatgaacctgcaaagcttgcctgttgcccagggttggtggggctgcctttccccactgcctggtggccagctgccttttgggagcttggaggatacctacagaatgctccaggctgccactacatagtgacagacgtcagctctatcttgctctgtcttgacagagcccctgtgggtagcgcttccactaggctcactcccttatggcccaattcagggagtttcaggaagagtaagttttcctggtcctgttggcctatggtttatagacatatattctccacatcactttttccccctatttcctgtatgtcagttctctagttcatgcacttcattaatcactgccatccagaactttttatccccccaagaagtctttgtttataatacttcgtgtaagcagttgaaggggccagctgggtggcaaagttatgattacttaaaaaaaaaaaaaaaaagcagtgagcctaggcaacatagtgagaccccatctctacaaaaaaatagaactagccagttatggtggtgcacgcctgtggtcccagctagttgttaggctttgacgagaggattgcttgagccttagaggttgaggctacagtgagctatgattgcgccactgcacaccagcctgggcgacagagcgaggactctgtctcaacaaaaaaacaaaaaaaaaacttaacagttaagatttcctcctgaaaaactttcaaaggacttaagtcttctacctgctgtttaaaaaaatatagtttaatttttgaccagataacatattcatatatattcccatgtaaaagattctaaagagtcaatagtaaagaagggctctctcttgtcttccctggaggcagacaatatcagtttctagtgaagaggcaagcaaatttttctattaggcaacaggttgaaaaatttcaggctttgtggacagatctccattctagagtatccttaaagagaaattttatgcaaaaacaagcacatacatattcatgtcttctcccgcaactctccccaaatggtggcatactgtatagactgctctggacttgtttttgttttttcttttctttttccttttttttttttgagacaaagtctcgctctgtcacccaggctggattgcaatggcgtgatctcggctaactgcagcctctgctcccgggttcaagctattctcctgcctcagcctcttgagtagctgggattacaggtgcccaccacacgcccggctaaattttgtatttttagtagagatggggttttgccatgttggccaggctggcctcgaactccacacctcaggtgattggcccgcctccggctcccaaagtgctgggattacaggcatgagccaccgggcccggcctggacttggtttttatcagttaaactgggggttggcaaaccatggcccaccagtcaagtccagcctgccacctgtggctgtaaggcattttattggaacctctgttcatttgtttacatattatatgtggctgctctcgtgttgcagtggcagggccgagtagttgcaacacagactgtgtggctgacaaaggctaagatatttgccatctggccttttacagaaacagtttgctgacctctgagctcaacagtgtgtctcaacctttctatatcagcacagaaagagcttcctcactttttttaaggcggcataatattttgttgtatggctgcagtataacttatttttaatcaggcccttttaatggatatttaggtcatttttgacttttttttttgttgcttaagacaggatctcactatgttgcccaggctgaactcaagcgatcctctcgcctcagctcccagagtaacaggctacagctgtgattcaacacacctggctcatttctaactcttttgctgctgcaaataatgctgcagtgaataagctagtacttagctcattttccacatgtgtgattatatttacagaatgaagcctggaagtggaattgctcaatcaaagcctgtatgcattgataatgtttatagctattgtcaaattgccctctgtggaggttgtaccaactgacattctcaccaatgttatgaaagtgcccattttgccctacctttgccagcagagtattttaagccttttgatatttatcaatctgccaggttaaaaaaagaggtagcccagggtagtttactttgcatgtcttttattctgatgcattgcacgttcttccatgcattgatgaggcgtgtgctccttcctcagctggcagtttactgtcctggtctgaggatcttctggggactggtctctcttgctgactctttcgtgtcattttcacaaacaaccttttgaggaaaaaaagtcttaaggacaaacacatgctggcaattagcgccatcgacattccagatatcggggctgggaaggcagggtgagacctgctgggtgtcatcgttctgctctgaactaggaggactgactttcagagggttctcggtgtcctcttcttccacagcgctcctgttgacacaaacagcctcatgttcctccagatttttgatggggaccacgtggcaggcgttgtatttgcaggtggccatctttttggctttcttggggttctttctcctgcacgatgccaggtggtactggaatctgctgagtgggattcggtggtgaggatcataagggcaaatttcaaaggcttctggctccatgagaaattcttgaagcagggtatctcactgctagagtctaacggaaatgcttcttgtggagaagcccttttgtaagaaggatggagttgtcctctgcccagttttggcccttgggattctgtaggtgacggtcttaacttgtggtctgttctctaggactgtgagtggtggattagaagagagatgaggagctgccaaaagcagctacacagagaacagagttagcaaatggcacccgagacagaactatagcagatgcaagagccaaaaacccacagccgcttgactcacggatatactatgatgtcaagctgcagtcaccggtggtcacaatgggcagcctaagtcatcaggaagaggctattgtgcactgcttgggaggggtggatggctttgggaatgctgccatctaaaattgctcatggatgtatgttgtgacttaagtcttttaactgtacgtatttgttttttgtttttgtttttgttttatttgagacagagtctcgctctgttgccaggctggagtacagtggtgcgatcttggcccactgcaatctccgcctcccaggttcaagtgattctcctgcctcaggctcccgagtagctgggattacaggcacctgccatcatgcccggctaattttttgtatttttagtagagacgggtttcaccatgttggccaggctggtcttgaactcctgacctcaggtgatccacccgcctcagccccccaaagtgctgggatgataggtgtgagcccctgcgctttgccagggctggtttttggatgtgattctcagggccgtctttctttacccttctgctctgctgaggcccacagcagcctagtctccttgggtgtgggggaagggtttaaatctattcatatatcgcagaaggtgaagccttttggtgttcagcttaacatgggaaacatttcctataaaacgccccatcttaggtcgaccctgccgttgtccctcacagaactggaccaaagtctgaatggacgcaattgacacatatctcagggtgttagtggttttggtcctctgacattctatttacatgtctggtgttaggtaggatttcttctaaaaattggcctggagctccttcccaccccccaccctgttaaattgtttctcaagatctgagtgacagtagagaaataccatattcctgaataggaagactcaaaatcataaatgaatattctctgtaaactaaattacataaattacatagtcatcctaaattgatacataaatataatgcaattccaaataatttttgtagctttatgtgctgatatctgatagagcaagtctctgcttgttattagttttccccccaaaagccttgactatcttcaaggatttgttattctagatcatgtgtcaacaaactatgggcccatgattcaaatccagatggctatctgcttttgtaaataaagttttattgaagcacagccacacccatttgtttatatattgtccattggctgcttttgagctagatttgagtagttgcaacagaatccagatgacctagaaacctctaatgttttctgtctggcccattatagaaaaagctcacccatcctattcttggtggtggttaaggaagctgactgtattcaaattctacctcctgccacttaccagccatgtgaccttggggaaggtgtgtgtgtgagtgtgtgtgtgtgtatgtgtgtgtgtgtgtttcctggtatttactaagctctattgatggtgtcttttcaggtaggctttgtagttttctttctattttttgcacgttaaaaaaaaattaatctatgatgctttatggttttttctttttcttttttttttgtcattgtaaatgacactttttccatctctccacatcctagctatggtgttcagccttttttgagaattgaagtgattggctttgtctacattgttacataattgcaactgatcatacatgtgggatgtcttgttactatcatatgacatgcagacaatttagcaacatgacactcactgatgtcatagtaagaaattgtaatgggaacccaggtatagacaaaagattagacaaaggattctaaaaaaaggcatctttcataactacaccatttattctgggtgtgccagtcaggataggcaaggttaggctgcaataacgtacagtgccaaaacttcagtagcttaaaacaacgaaggcttatgagtcactttcaagtctaaagcaggtttctgggttggggaggggtattggggatctgctccttgtggttaatggagccaggctgatggagcctccatagcaacacttgcttccttctagaagaaggaagaggatgtggggagtcatgcgcgagcttccaccaggaaatgataaacatcacttccgctactgtttcatggttcaaagtaagtcctacctaacttcaaagagcaaggaggtacggtctttccacatgcccagaaggaggagaataggaactttgggaagtcctgagggcttccccagtctgcccttctcgtcaccagcattcatttctcttttctccacacacacggagcatattcttccccatggaagaaaacccaaagtcctagctcagagtgggggatcaatggcttactcagtgctctcctggggcttcttgagatcttgagatctggctcttaccccagaccagtggaattctagtgcctcaaaccaagctggctcctatgaggagtatgaggccaagaagttgtgttccctgtaccccaacccactcaccctagggatagctcctggtttgctctgctgagtgtccttggtaaactgtaccttccatatcatgcatgtaacacagagcccattttcttcaagcctacagcccactattaaaggaaatatggtcgggtgcagtggctcactcctataatcccagcactttgggaggctgaggtgggcggattgcttgagcccagcagttcgagaccagcctgggcaacatggcaaaaccgtatctctacaaaaaatacaaaaattagcctgctgtggtggtgcgtgcctctagttccagctactcgggaggatgaggtgggaggatcgcttgggaagttgaggctgcagtgagcctaaattgtgttactgcactccagcctgggcagcagagtgagaccctgtctcaaaaaatatattaaaataatttttttttgagacggagtctcgcactgtcgcccgggctggagttccgtggtgcgatctccgctcactgcaagctctgcctcctgggttcacgccattctcctgcctcagcctcccgagtagctgagactacaggcgcctgccaccacgcccggctaattttttgtatttttagtagagatggggtttcaccgtgttagccaggatggtctccatctcctgaccttgtggtccgcccacctcggcctcccaaagtgctgggattacaagcgtgagctaccatgcctggcctaaaataatattttttaaaaggaactatagtgttgtccttactgggagttaacagggagttcagcatctgctcttccacacccccaagcctggtgcagtgtctgccaatgatgctgatagcaatcttctttttttctttttgggatacagtccctctctgtcacccaggctggagtgcagtggcaagatttagtctcactccatctcaaactcctgagctcaagtgatcctcccacctcagcttccggattgctgggacttacaggggccagccatgacactcggctgatttttttatttgttgtagagatatagtctctctatgttgctcaggctagtcttgaactcctgtgctcaagtgatcctcccactttggcctcccaaaggtctgggaattacaggcgtgagccaccatgcccggctgacagtgactttttaatccctagtgccatagtctttttcatgcttccgaccagaggtggcccaggctggagtcttcaggcttctgtaattctggttgtctttgatcgtttgtggtttattgtccttgaaaaattatttgcgagggtttccaaagcctaggttacatgtgcctggctgagagaggcttttaaattctgcatatggagatcacaatgaaagcactgtatccgtcattgaaatccacataatgaggagtaagacattgctgttgcaggtttctttgtgaccacgcacctattagtgtggcaggctgagattcagtccattatggagagagggaaggctggggttgtttgtgcttcttctttttttttttgagatggagtctcactctgttgcccgggctggagtgcagtggtgtgatctcggcttactgcaacctctgcctcccgggttcaagcaattctcctgtctcagcctcctgagtagctgggattacaggtgcccgccactatgccctgctaattttttgtatttttagtagagatggggtttcaccatgttggccagtctggtctcgaactcctgacctcgtgattcgcctgcctcggtctcccaaagtgctgggattacaggcgtgagccaccgcgcccggctgtttgtgcttctaatggacatcttgaatggtcctcaagcctgcagcctcctcctggcacctgctctgagcctgggacctgagaggttgctcaccatggcaacccaagaggagctagggatgcacacacatctgtctgtgtgaaacttttcaaccctgtctgtgcatgtgtgaccagcgctgcaaataagatcggacctgctttcctctcactcccctccctgctgatcttcatcctgagagatgctgccaacagatggtaacacaggcatggagaggaggtcacagagtgtgcagaaacagtgttttctgaaaatgagaaatggcatgtcctggttagctgagtcagcaattatcattatggggtgggatgcagccatcggaggattagtcatcatgaatctgaagtctccaggcgaggagagagtctgacgtcatgcaggccagcttctctcccagggccggcatgccccccagagcatccctggaggatggtcagacagcgatggggagctcactacctctccagacagttcaattgttaggttgcacaccgagctgaccgcctcctcataccctgtagcagttagtgtcaacactgtgccctctgccccaggcacctcctgcaggttaaaggagatcctaagcatgctaaactcaagctgtgtgtatgtggcgttagtatgggtggccactccatttctggctccttgagtctccctgccatgtccaggagacaggtgtggacagcataggtagcccccatgggcttttgggctctggctcagggcttctccatgctgaccacctctgtgggccaccccttgcccaagggcttctctggtctcagccgtctgggcacctgccaactcctttgactcaaggaccttatttagaaaactctcttcatgtagtgacaatgagtgtagcaccatgtagcatttctcaaactataatgtggccaggaatcgcttgggttctggttaaaatgcctgactgggtgacgtttggttgtctttgtcgggttccatgtcacagctatgctagatttgtaaactgaatcagagcacattctcttttttgttttctggatggcttaaacagcctacaaacattctttgaaagtctgagagaacttgtctgctaaactctctgacccacaccctgttgggaaatagtcctctgtcagttttaaagttgattccctggttttttacttctcttggcaattctcatttttctagaaaagtgtgctgttatggactgaattgcatccctctcaaattcatatgttgaagcctgtgacccccaaatatctgagacaggtctcagtcgatttagaaagttccttttgccaaaattaaggatgcccccgtgacacagcctcaggaggtcctgacgacatgtgcccaaggtggtcggggctcagcttggttttatacattttagggagacatgagacatcaatcagtatatgtaagatgtacattaattccatccagaaaggcgggacaactggaaacaaaggcaggacaacaacaaaggtagggagggggcttccaggtcataggcagataaaagacaaacagttgcattcttctgcatttcggattagtctttccaaaggaagcaatcagataggcatttatctcagtgagcagagggaagactttgaatagaatgagaggcagatttgccctgaccagttcccagcttgacttttccctttagcttagtgattttggggtcccaagatttatttttcctttcacaagccttaaccctcaatgtgactgattttggagatagggccttgaaggatgcaattaagcttaaatgaggtcataaggatgaggccctgatctgataggactggtgtccctaggagacgaggaggagacactagagctctctctactcctgcacagaggaaaggccaggtgtgcacagagcaaaaaaggctgatatcagcaagccaagaagaaaggccttaccttgccctgctggcaccttgatcttggacttgcagcctccagaactgtgagaaagaaatttctgttgtttaagccacccagtctgtagtatttccttagggcagcccgagctgaggaagacacgtgttctccactgaactctcccagctgactagcacactgcatgcatttaatactcttctaatttgaaacctctcctctgtgtctttgattacatttccttgacttctctactgtgtttctgtgttctctctcgctcacttgcttcctacttcctccccctgcccaccccacaacctttttttttgagtcggagtcttgctctgtcacccaggctggagtgcagtggtgcgatctcggctcactgcaacctccacttcctggattcaagcaattctcccatctcagcctctcgagtagctgggattacaggcgcctgccaccacgcctggctgacttttgtatttttagtacacatggggtttcgccatgttggccaggctggtttcaaagtcctgacctcaggtgatccacctgcctcggcctcccaaagtgctggcattacaagcatgagccaccgcgcctggccgtgtgacccctccctttattgggcttccacaaggctgggtgtcctacagctgtttacaagaaaccaagtctttgatttatcagttctatggatttttatgttttctatttcattagtttttatctgtatttctgcttctctccctgggtttatcgtgttgcttattttctagctccttaagttggatgcttcatttgccttcagtcttccttgttgaataacagaaacatttgcagctatggggcgtacttcggtttcattccctaagtatggctacgtggagttccaattgtcatgacgttctgaatggcccataactgcagttttgttcctttctttgattcaagttatttaggcataaatttccaagtgatttcatttttttgttgttgttgtctatccttttgtttttaatttctgtttttattgcacggtggatagataatgtggcctgagaaaacgatggcttgttagtgcctgtgaggtgttcttggtggcctaaaatgtcatcagttttggtcacttccttacagatgtttgaattaaatgtcttccctgtttatacctatttattaaatgatgcttgtttttccacgctggcattgcttggaatgtgagtcctacaagctgctctggggattgtcacactgtaccttctcctggggaatctcagtggacatcagcacagatccaagaaggcctaaggaaaagccaaccatgaacctttgcttcactcagtgtctcccaggtgcagccttttctctttagcacctgttgctacctctaccagctagtttcctgtggaactagttgagaaaactctgttttaaggttttctcgtatttcttggggagtaactatttgttaagggtcatcagtactcatttctcaggtataacctcactctgcctcaccaaggctagagtgcagtggtgcaatctcggctcactacagcctctgcctcccgggttcaagcgattctccttcctcaccctcccgagtaactgggtttacaggtgcccaccaccatacccagctaatttttgtatttttagtagagatggggtttcaccatgttggccaggctggtctcgaactcctgacctcaggtgatccacctgccttggcctcccaaagtgctgggattccaagcatgacactgtgcctggccaaactcttcctttttttttgagacagagtcttgccctgtcgcccgggctggagtgcaatggcttgatctcagctcactgcaacctctgcctcccgggttcaagtgattcacctgcctcagcttcccgagtacctgagattacaggcatgcaccatcatgcccagctaattttttgtatcattagtagagatggggtttcaccatgttagccaggctggtctcaaactcctgaccttgtgatctgcccgctttggcttcccaaagtgctgggattacaggcataagccaccgtgcccggccaacttcctcctttttttaaaaaattagagacgggggtcttgcttagtcacctaggttagagtgcagtggtgcaaccgtatctcactgtagcctggaactcctgggctcaaccaatcctcctgccaccacacctggctaagattttaaaatttgttttagagacaaggtctcacatgttgcccaggctagtcttgaactcttggcttctgccttagcctcttgagtagctgggattacaggcatgagccacagtgcccagttgacctcttccttttcatctctgggcctatctgtgagtgctgagctgcttctctgctggagtggagtgtgtccgtgtggcttctgtctgatgctgaggctgtctcagttcaggctggattctctgtccttttgctcttggagacttggttatcgagggacccaaccaaggagtgaagctgtgtagtgactttactgatgcgcccaagggtttttctctttgttgtagcagcccaaagttagctggacctcaggaacaacccacacctcattccaacatcagcgcaggagggcgtgagatgtggccacagcctgtggcaccatgggatgggccagccctcctgccccttcagcaggggcaacatcagcgctgagctttagtcctcagtgatacctggtggcatttgcttctctgccacctgctgctttgagcttttcagttttgtggagttctactggtattatgctagagttcttccagaagtagaccctaagatgagatttcagatataagtagttcattcgggaagtgcaggtaaggctgtggagaaagagtaaggaagatacatttatagatgtactcacataccaatatttaaaactaataagagtcaaaaattataacaattttttgtattttcttttcttttctttttttctttttttttttttgagacagagttctactcttgttgcccaggttggagtgcaatggcgtgatctcggctcactgcaacctccacctcccaggttccagcgattctcctgcctcagcctcccgagtagttgggattacaggcatgtgccaccacacctggctacttttttgtatttttagtagagacggggtttctccatgttggtcaggctggtctcaaactcccaacctcaggtgatccgatcccctcggcctcccaaagtgttgggattacaggcgtgagccactgcacccagcctttttttgtattttctaaagttttaatgggcatatttttctgtaacaagaaaaatcaagcaaaaattatatttagaaaagcatggaaactagtaaagactttcaaaggtcaaagtgtgaaaaatcccccacgtgattcagctgtctacttcagtgggcatctgaggcctttaggggaaactgtgggaagtgatacaaaacactcaactcagaactaccccacccaaggggtgggggagctggggcatttacaccccaaccctcaagagagtcatttgttaaaagctatttctggggttgtgagataggaggtgagacttgactccagaggtggggctcaaacactggtctagattgaggactagctaaaacagggctggggtgaaggcagctttcaatctgacacagccaccagtgtgttaagtcagtttactgttgccatggcaacacccagggttaccaccccttttcaaagcaatgacctcaaagttaccaccctttccttagaaatttctgcataaactgcccctttatctgcatgcaattaaaactatgtgtaaatacgattgcaaaagtgccctgagcagctactctctgccaatggggtagccctgctgtgcaggaacagtcacagagctataacaccgtcttttcaataaagctgttttcttttacctctggcccttgaattctttcctgggcaaagccaagaacccttgtggactgagctccactttggggcttgcctgccctgcatcataaggtctttggcagttccatcctgtcaggcatgggcagttctgggagcaagagcctcatttctagttgcagaggctggaagtggaagctggccagagcacactgaaaagtcacagggatacaggtggggtgcaggccacttgtgccatgggtccctccaacttagagattcatgtcttcttacttggtgacttacggggtagtcagtcccacaaatgcttaaacagccagcattttaaaaaaagcatccatttgtagcatctgccaatttccatgttgtcaatattcccaccatggccaatttcaagctaccagtggtttaacagcagtcaacaggcgaggaaaacaggtaaagtaacactcctcgagatagacctgtagcaagtgacagagttgggggtgcagcccaagcctgccaaactaaaatactcttgcgccctttttttttttttttttttttgagatggagtcttgctctgtcacctaggctggagtgcagtggcaagatctcagctcactgcaacctctgcctcccgggttcaagtgattcagcagcatgaaaacagactaatacagccatgttggtctggctggtctccaactgccaacctcaggtgatctccccatctcagcctcccaaagtgctgggattataggcatgaaccatcgcacccggcttactcttgcacttttcgtgacatcaggttcaggtgagctcaggcgtttacggtgttgaccttgtgggtcaaagatctctggtgggaagacagacagacatccttctgatcaggatacagtgagtgcaaggatgaggggacagctggctgctgtctttcagataaagactgagctggcctggaggataagcaggaaccaacaggctgtaggaagggtgttcctggcaggtggaccagcatgagcaaagcaccgaggcagtaagagcggctgggctggggactatatatgagatgtcccctacaaagtgggctggcaggggaggggtggaaatgcacatggagttcagacctgagggcatccttgctgggtgctgaagtgacgggttgctgaggaaggcttcaagtaaggaagtgatgtggacaggtttccatcttattttctgtctctggggcctgtggttttaagagcagcaagaaaggcagggggcctggttagggggctaaggaggcagagattagcctggagtggtggctcatgcctataatcccagcactttggaagggtaaggtgggtggatcacttgagcccaggagtttgagactagcctgggcaacatagtaagcctccgtctctacaaaaaatgaaaaaattagccaggtgtggtggtacacgcctgtggtcccacctactatggaggccgaggtgggagaattgcttgagcccaggaggttgaggctgcagtgagctgtgattgtgctactacactgcagcctgggcaatagaactagaacttgtctcaaaaaataaaaataaataaaaataaaaaagcagagattagagaaatctgcccagagaggtggtttatagaagcccacccacacaaagccatggtctaagcacagctggactgtacaggaacccaagcacacagcaaccaccattctcaagcacaacaggaggatcccctctgaaagaccagggcaggagaacacatcccagacagaggacaggaccccctgccagcccttgccagcccctcccggcccctctcccctggtgagggccacactgctgcagagggtaaggagaattggattcaaaacctaatagactggtggctttgaacaaaccagtgcccctccagtgcaggcttctcatctgtaaactgaagactgactagaagatcgtattaaacactgccgtgctcagggcaatcttttcctagactacgcatttagcaaaagtgaagctgattgaattgagaagtaaattctagccctattgtttcagctatcctggtctttcagccttgtggaaatgtgagtgagtcggtgtgggccaattccaccagacacagcactgggccggttcctcactctgcggggtccgccttatgttccagttcacctcaagggcttctagcatgtgtctggcctcctcgctggtttacatgtgaatatagattttcctgtgtttttcctttgaccattttagcaagcatttggcagggagcagttaaatggatcccagagtcagtcatctggaaatccctttgcttttaacctttatgtagcatttcattggccctgggctttttgtaaacaagctatttgtgtatggggagggaaagctctgccctttgctctcactctgtcttctctccaggaggagctgctgacctggtattccagattgaggaacccacttttcctggtgggagggtcgctccctcttttactttgctcctcctgggtctgggagggggccatctgcccctttcttggctcttattttctaacacacctgttatggtgtgctgggttgctacatgcgatccaggaggccaagttaaatttcagataaacaatgaatagttttctttagcacaatgtcccaaatattgcttgggacatatttatatttaaaaaaagtttaggctggatgtggtggctcacgcctgtaatcccagcactttgggaggccgagatgggtggatcacctgaggtcaggaattcaagactagcctgactaacatgttgacaccccgtctctcctaaaaatacaaaaattagctgggcgtgttttccattttcttttgtttcttttgagaatctgttccttggaacttcatgaggaaggttaatgggtgcctgcaatcccaactactctggaggctgaggcaggagaatcgcttgaacccaggaggcagaggttgcagtgagctgagaccacgtcattgcactccagcctggacaacaagagcgaaactacgtctcaaaaaaaaaaaaaaaagaaaagaaaaagaaaaagtttagtgtttgtgtgaaattcaaatttaactaggcgtcttctatttttatttgctgaatctggcaacccatgtactctaagaactattctaaggggttctctggaacagctggccgtcagatccagatttgggtttccatggagcctctggttaggtctgcaacgtcattataataatgtggaaacacgttttccgttttcttttgtttcttttgagaatctgttccttggaacttcatgaggaaggttaatgggcagggtaggacttgggtattccctccagcgagctgccatcatatatcattaaaacctcactttggctaggcgtggtgtcatgtgcctgtagttgaagccactcaggaggctgaggcgggaggattgcttgaaaccaagagttcaagtccagcctgggcagcctagcaaggccctgtcactgaaaaaaaacaaacataaccaccaagccaaaaacaaaacactaaacatctcacttctttgaggtctaacaatctgtagtttagattttgctttttgattcaacctaagcattttagatgaatttaactcatgcacatttattatgacggctgttacccgtggtcttaattctgttatcttgttatgctttttgtttttagtgagccatgttttcttgaattagttttctttggtgtcttagaagttacacatcctttattatatcagaagttattttaaatagaaaaatattgagaccattttgtttacatatcaaatggcaagaataaaaataaccagaataccatctcattggttgacgacatcactcatctacttccattcactcctgcaaaccaggagttttgattcctttcttttcctccttccccatgtcaaatccattatcaagtcctgcaactcttaacttctgaacagtttttggatctatccaatttatcctcatcactactactccagtactattgaccattatctcatgtccagtctaagatatgattccccatgccattcttcttttacttcctttcatgtatttctttctttttcttttttgttttttttgagacggagtctcccttcgttgcccaggctggagtgcagtggcatgatcttggctcactgcaacctccgcctcctgggttcaagcgattttcctgcctcagccacctgagtagctgggattacaggtgtgcaccaccatgcctggctaatttttttggtatttttagtagagacgggatttcaccatgttggccaggctggtcttgaactcctaacctcaagtgatacacctgcctcggcctcccaaagtgctgggattataggcgtgagccaccatagctggcccttttcatatacttcacacttggggaaattatttgggattttcagaaccagatggttatgaccttcctaccctaacctggtcattaataaacaattattttaacatattgtgtatcttcagctttaatatttattttggacatatgcaataggttgcatgcctcattatttgtggtcagccctgtatttttgcattttcattgttggcttttattttctctgtactgtttcttccctatttctgaatttgctgtttggattcctcaatcttattctctgctgctaggccatcaaatgctggagtcctgtgagcttagttttctcttctctcttattgtctagatgtagataactcaccagtatgcatctggaggtctaaaccatctgcatagtgcaagcctgtgaatccacattggacatctcatggatacctcatacttaaccttctccaaaccaatctaaaactgaccttcctgccctaacctggtcctgttttagagtctccatctgtactagtcagggttctccagagaaacagaatgaacaggataggaaaaatgaggaattggctcatgtgattatggaggctgagaagtcccatgatttgccatctgtaaactggagacctaggaaagctgatggtagaattcagttcaagtccaaaggcctgagaagcaggggagatgatgatataaatcctggttggaggacaggagaagatgagaaatgtctcagctcaagcggtgagttaggaaaaaagggacaaattcctccttcctctgccttttgttctgttcaggccctcagtggattggatggtgcccatccgcattagggagggccacctcctttaccaagttcactgattcaaatgctcatctcagccagaaacactctcacaggcatacccaggaacagtgtttaatctgggtaccctgtggcccagtcaagttgatgaataaaattaaccatcacccatttcctctgctgacatcacccatccacttccattcagtcctgcaaaccagaagttgtgattcctttcttttccacctcccccatgtctaatcaatcaccaagtcctgttactcttaacttctgaacagcttttgaatcaatccagttctcttcatcctcatcacaactgttctagtcctattggctattatgtctcgcctagtctaaggcagtagtctactaactagtctcccaactcccttctggtctctgtcttctagacctgaccctgagggaaggtctagaaatgcaggcaggctgtccccattctgcttcctctacactaagatctagtcaggatccttcaggtgcccacaaggctctgcaccctccgagggctgccatacctggccatacctggcatgcgcttccttcctatcctctctgcacaccagccacactggcccatcctggccactcctgggctccgtgctctctgccaccacatggccttggcatctcctgctttctgttgtcttctttctttacgtgcagaagctcctgcctggcctttggagctcagcctcccctgaactctctgactcaattaaattcctctattctttaccctcgtagcctcacatgcctttccttcatagcattatatgacaactgtcattttacatttatttctttctattttctgatgaatgcctgcctcccccagtagactatcagtccccagaagcatgcaccttgtctttttcaattcattgctgtatctccagtgcccagcacagcacctggtgcatagcaggtgctcaagaagtatttgttttgaataaatgaatgatttagagctgatcacagctggaagagccactgaaggtcatcactattattaaaagtagatctcaaggcttagatcccagggaagggaggaccccagagaagcctgtgaaatgagagtcaaattttagagtgttgccgggcatggtggctcaccacggccatttgggaggccgagatgggtggatcacctgaggtcaggagttcgagagcagcctggccaacatggcaaaaccccatctcttactaaaaatacaaaaactagcctggaatggtggcgtgcgcctatagtcacagctactcaggaggctgaggcaggagaatggcttgtacgcggaaggcggaggctgcagcaggttttctgtgtttttagtttcctaagcttggcttggcacagcacacacaaagccatggggacccagagcttgtgacttacaccgtgaagcacagggtggggaagaatgagtgacagtgaagaatgttcccttgcccaaaaggagatgattcggaaaagagcagatggaggaggtgtggttagggataggagttactgggtccccaagaatgagtccagcaccccatccctcagaggatagaaacccatgttaaggttgtagggatcccggaagactcacagagaagcccactttggtggagcagcagtggcaaagggaggtgttggaatgcagtggcctcaggacagcctcctggggatctgggatcctgcacagtgtgagggagcagattagagttctcacacccctggagagagcgtgcacgtagctggggtggatgactgtcctgggggggctcaggctcccaggaatgggtgatcagggaccatggcagacctatagtcacctctgcagaggcagtggggactggggtgactcagactccagcgaggtcagcgaggaaccctcccagccaggcgactcaccccagatgctggagtggtaggtaagcccctccccacaccagctgcaccacctctgggtggagtgtgtgtgtgtgtgtgtgtgtgtgtgtatgcatgccggatgcgtgtctgaaatctgaattcagtgagtgtttacctaaagaacagtggagtgaagtggctgctgtacttcatgtttgcaactgtttcccaccttcagtggaaatgggagcttaaaagctcagataagccggggcgatggctcatgcctgtaattccagcactttgggaggccaaggtgggtgggtcacttgaggtcaggagtttgagaccagcctggccaacatggtgaaaccctgtctctactaaaaatacaaaaattagctgggagcggtggctcgtgcctgtagtcccagctactcgggaggctgagacaggagaatcacttgaacctgggaggcagaggttgcagttagctgagatcacaccactgcgcttcagcctgggcaacagagtgaccaaaaaaaaaaaaaaaatcaaaaactcagataaattaaatatgcagaaatagagaaagtaataggtttttatccctgaagatatagtctgggaaatttatactcattccatagtatttatacgagtatttttactcattccttgtattgcttgaagttccagcgaagaacagaatcctactcagatggatttcatggactattatggagaggtgggcggggcaaagagccccaaccaaggctgcagaggctcccaggcaccagcagcaaggggaagcctgccggggtggggtaggggattatgctgttgaagtccattgacagctggagacagaaagtagaaccacccagcaagagctggggttgagggactaagccactgcccagaatgagacctgaagaaggaaggaagcaggaagaaatatccctacttctctctctcctcccagcatccgaaacctggaagccagccagcaacgatgtgtgggtgatgcagtccacaggggccaaccttccagggcccacggcagggtggaaagatgggtggaggggggcttgagttaaagaacagatggggaaactgaagcccagacagggtaaggacttgcctaaggtcatttagcaattgaagggcaccatgaggactcagcccctgacttccttcttctcataggagggcttcctgctcaacaccgtgctttattgcctgcacacacagctgcgtggtcgcttctcattttcagactttgttgtaaaaagaagtcggaaaatgcaaacattgtatgaagaagaaaagaatgtgttggcgtctagtcttccaggctgcctctctgtgtgtggacacatattgatttattttaatgttcttaattttagattcggggggggtgtgtgggcaggtttgttccgtgggtatatattgtgtgatatgggtttgggcttctgttaatacccaaacagcgaacataggacccgataggtaatttttcaacccctgcccctctccttccctccttgctttttatttattttggagacagggtcttgctctgtctcccaggctggagtgcagtggcacggtctcagcccactgcaacctccgcctcctgggttcaagcgattcttgtgcttcagcctccggagtagctgggactacaggcgtgaccaccactcccggctaagttttgtatttttagtagagatgaggtttcatcacgctggccaggctggtcttgaagtgacctcaggtgatccacctgccttggcctcccaaagtgctgggattacagtcgagagtcaccaccgtgcccgactcctccttgcttttagagtccccagtgtcttttgttcccaaatgtgtggacacacatttagtaaaaatgggagtgggctttgtaaacctaaaagtatttgagacaggcctcaatcaattgagaagtttattttgccgaagttaaggacatgcccagaagaacagaacacagaatcacagaaacagtctgtgcctttctacaaagatgattttgagggtgtcagtacttaaaggggaaaagcaggctggagggaaacgagggagggtgtggtcatattactgaattcacatgttgcaagagaaaaggagtagatgggggactcgtcaattatgtattcatctagcactcagtaaattggcactttaagtaagataaggtgaaccagagtaattggagatatctggccttttatctctacctatctgcttaggcacaaaagggaaggcgttttcttgcatgactcagctttcagcttaatttttttcctttgggtagagtgaattggagtcccaagttttattttcctttcacagtttaggaagtcgggagaggtgggttcgcctgggaactcatagtgagacctgcactctgaattccttggaagacagaggagaaaaatgaagggaaaaaaaaaaggtggggaggtggtggagggagagagggaatggttggtgctttggccaagcctgagtttccccagctgctccttgtttaggcaggagagacaggcaaactgcagagcacttgtgagttcccatgggagcccctgcgccctgtgggtctgtttcagcattgtcctccgtgctggggatatcccagctcccagcttcctggaaggctgtcgtgttaaccacgttaacactttgtgtggggctcagcacttgtggagtgcccgtttagttcttagagtcgccctgtgcagggccaggtaatgcctaccacgtcctaaaatgcactgcgtgccccactgtgccccactggaggtatgtgagtgacatttcatggtgttttggtggacagttttaatttcagtaattacatattgatatggtttgggtttgtgtccctgcccaaatctcatgtcaaattggaggagggctctagtgggaggtggttggatcgtggacgtggatttcccccttgcgttctcgtggtagggagtgagtgctcatgcgatctgatggtttaaaagtgtgcggcacttcccccttcatgcgctctctctccggctctgccattgtgaagatgtgcctgcttcccctctgccttctgccatgattgtaagtttcctgaggcctttcagccatgcttcctgtacagtctgggcaactgtgagtcaattaaacctcttttctgtctttctttctttcttttttttttttttttagacagagtttcgctcttgttgcccaggctggagtgcaatggcacaatctggggtcactgcaacctccgcctctcgggttcaagtgattctcctgcgtcagcctcccgagtagctgggattacaggcatgcgccaccacgcctggctaatttatttttatttttttttatttttagtagagacagggtttctccatgttggtcaggctggtctggaactcccgagctcaggtgatccgcccacgtcggccccctaaagtgctgagattacaggcgtgagccactacgcctggcctaaacctcttttctttataaattacccagtctcaggtagttctttatagcagtgtgagaatggactaatacacatgtgttttaatgcatcttagcggggctgatcataaacatatttgacaactgaatggcacaggcatcaacgaatcagaacggatgctagcagtaaatagccatgaatgtctctgggactcataactgaactgaaaggggctcaattttccccacccgcctggtgattggggtgctcatagtcccccaagagtgggttcctgctgttttcaccccaccatcctggcctccagaaatccactctgagctttgagcttccatacagggagctcaggggagggtagggaagaagaaaggagcgtgggggtggggggagggctgctgcctggagctgcctctcacacaggaccccctggatggtcactctgtttctgggatatttaacccctgaaactgtcccctgagcagctgtgtcacccctgacctgctgctcagtgtcaccccctcttttattttaagaaacagagtcttactctgttgcccaggcaggagtgcagtggtgcaatcatagctaactacagcctcaaactcctgagcttaagcaatcctcctgccttaagcaaccctcctgagtagctgggactacagatgcatgccaccatgcctggctaatttttaaatgatattttgtagagacaagatgttgctatgttgctcaggctggtctcagatttctgggctcaaccaatcctcttgccttgacctcccaaagtgttgggattataggcgtgagccactgcgcctagcctcatctctcctgttttcatgtgtgcctttgtaaattacttgtatttcactggttactttttgtttctataacatgttttattgtgacacataaaatgcaggaaaaaatgcataaagctcatatgtgcaggttaacacaggactgtaaaaatatcctacacaaagaaggagaactgggttccctggggcccccaccatctcttcccatgacagcctcctgatccccagagaaaagcactatcttttttttttttttttttgagatggagtctctctctgccgcccaggctggagtgcagtggcacagtctcagctcactgtaacctctgcctcccgggttcaagcgattcttctgcctcagcctcccgagtagctgggactacaggcgtgcaccactacactgggctaatttttgtatttttagtagagacagggtttcaccatgttggtcaggcaggtctcaatattctgacctcaagtgatccgcccacctcggcctcccaaagtgctgggatttacaggcgtgagccactgtgcctggctatcctaatttttataacgctaatttctttgctgttctttatagtttcaccacttaggaaagcccttgtttgttttgtttgtaaaatgacagtctttttatttatgaaaatcttggtaatcctggttttgttttcatcccctccccaccatgtcccctcctctcccccagcccaccatttatggcaagtgaaatccacctctgtttactgtgggtattcatttctctcttaacatgaattataatacataaatacgtttattaaaaatttttttttgagacagggtctcgctctgttgcccaagttgaagtgcagtgggtgatcatagctccctgcagcctccaactcttgggctcaagcgatccatcctcctgcctcagccttctgaatagctgggactacaggagacagccaccaccacacccggcaattcagagaaaaattaagtaaagaatagcatgtataaatgagatgggcaagatgatgaaggtggtacccaaagaactgaagtttgggaaacgttgattatcttccatttatgaagaaaaaaaaagtcttggggaggtctctggagggtcagggactggaatccaggtgcgctgacctaggccgacgtgggccaccgggacaccacagcccttggggcgccggcggccggtgttccttcagggagcccagaggctgcagtgccgctatgcaccaccagagggcagcacggccccggcttgcggctcccggccacttcccacgcgggcggctggggtggcgctgggcggctctccctggggattcgggtttgcctggactcatcttagtccagagatcctcaaacgagctctgggacacactcccttctaaattacctgggtgcttgttaacagtgtagagtttggggccttcctggacctacagaatcagcatccctgaagctccaggtgtgtggcgtgggagctagggggtttggacagtggggtgctggtcaggggagttttgagaacactgctccagggaggtgggcactgtctcccagggtcagagtttgggggtgatgtgtgtgtgtgtgcggaggattatcacacacaccgagagggattgccggtcggaagcctgggcttgcatttgggcccacctcttacttggatgggtggcaaattcttcgttaagcattttgcatctacgcaccctccatttgaccacccatccatccatcatccataaatatatgataactaaacccttaccatgtgtcccttctgtgtgtggagatatagtggtgagcaacacagacagcgtccctgccctcctagaattcatgcctgtgtggaggagccagatagcagcaaataatccctcaaatataaaattacatgttaggctgagcgcagtggctcacacttgtaattgcaacactttgggaggccaaggtgggagggttgcttgaggccaggagttcaagaccagcctgggcgatatagcaagaccccatctttacaaaaaatttaaaataaaattacaatttataggagctgccttgaaggaggagggattcatagggtgctgtgtggatgaaaagagctctaggaacctgaggatgtgaaggattcttcccttaggaaattatgcttgaattgagatctgagggtgagaaggagtgaaccaggtggagtcagagggaagagtgtttcagacagaggaaactcatgtgcaaaggccctgaggtggaaatgagctcactgccttggcagaagagtgtggttggagcaggaaggaagagagggactggctagacctggggtgtgggcagtagacaaggaccagtaccctcaggttctcaaatttcccatcttcaaatggggcaacaagagaaccatctatcttgcaaagaggataacatgtaatgatgagcccaaagcatctaatgtagtgcctggtacacagttggtgtcaatattgggggtgggggtggatctgggcagagggtacagcctggttagagagctgtggggaagcactgggcaactgcggggaccagagctgtcttggccacctgcagggaccagctgagaagtgtgtttaaccacagtgaacattaccgttggcatcgctgtcttgttgaaaacaaagtgaaattggagaacatactgttgtcttgaactaggccaagatgactaattattagactcacttttgaaaggttaccatatacagacatgcgctgaggtggagagaggagagtttggaaatctgattcattctgaaaccccaatagatggaactcttgctcagtttctgagcataatgactgtgaacattcggtttaacgcagctgtcaccacaggcaaggtgcaaaacaaaatgtttcgtaccagctccttggagtgtcatggggcagctcatggcagccctggggagatctctgctagatggtgaagggtgtgcaacgtgggtgctggtgttggggaattgaggggacgccagacctcaaatctgggatctgagtctgagggatggctttgccacaagtggaccatgtggcttaggttaacttcctcctttctttgggccttagtttcctcatctggaaaatgaagggctagaccagatgctctccaagaacttctctagttttgttgttctatggcctttgctggtggtgtgactttggatgttaccttcagctcctgggttttagtttccttttgagcattttagagttccccaagagtgttggtttatttcactccccatttgctgcccccaccaatgaagtctagcgactcgaaatctccttctccagactccactgagaacaaaccaccctagttccttgccctgtgggtcagtggtttaatctggggatgcgtgagtcccttggtcctgtctggagatgcataaatccactgtggcccgatgtggggattccaagtccttgaggtctaatctggggatgcatgtggtccagtactcacagacccaagggggcctgaaggcacctggacccttcaggaagtcctgtctctgggacttacaagggaacattcgtgaagctggtatcagggctgaacgtggattggggctttctgagggccaagtgcaggcactcatttccttctcacattattcccacctctgaggggcagagggtctaagtaattttcccaaggccacacagggagcaaggggcagaggtggcatgtgtgcccaagcctgtttgattcaaactgtcgttaactttggaaactgaccccaccatctcatttatttctcacaacaaatacatccattaacaggtatcaaggcttagaggcttcatagcaaaacagagtggagacctggtaggtaagcaggcagcttccagatttctccacccagcccccacttcctggccaggaactggaggcagggaagttccattgcccatatagctgcatgacttttcatttgcccgttcctgtggtcagactcagtggtgtgagacttcctgtggttgagccgagtgatgcaagaacgtcgctgtgcagggctgtggtcctacaccgtccactttattggttgtctaagacatcttcaatggtaaaatgggaaaggcatagtttttgtcctgaacgttgtccttacacctaagccagacttgatcagatgccacatggggcgtatcctcctgagcatcccacgtctaccgcctgccttggatgtctgacatcaagtatgtaagtgcttgtgtctggacctgaacttcactccaaatagcggggttggctacaggtcagttacccatgtgagattatagtgccctgactggttattctttttttttcttttcttttcttaagacagggtctagctcggttgcccaggctgccgtgcagtggtgtgattgctctgcctcctgggctcaagccatccccccacctcagcctcctgagtagcttgaactacaggcatgcaccactgtgccagctaacttttgcattttagtagggatggggttttgctatgttggccaggctggtcttgaactcatggcctcaagtgatccacccaccttggcctcccaaagtgatgagattacaggcgtgagccactgtgcctggccacctgactggttattcttatcaagatgagaacagaactgaaattgaacataagccaccattaattatcatcagtaatgtatttaagaatataaggcataattttaagttacactaaaataaatataaatggcttgacacaagtaaacgttcttgctcaacccttgataccctctagggatggatctgaagatccatcccctagacacatgaatatgatttttcaaatcattattattacagttttatagagacagggtcttactctgttgcctaggctggagtacagtggtgtgaccacggcttactcctgggctcgaactcctgggctccagagatcctctgtattcatctgttctcgcactgctgtaaagaaatacctgagactgggtaatttataaagaaaagaggtttaattgccacatgattctgcaggcaatacagatgctggcatctgcttggcttctgaggaggcctcagaaagcttccagtcatggtagaaggtgaaggagaagcacacgcatcgcatggccagagtaggagtgagtggaaaatggggcactgctacacactcttttttttttttttttttgaggcagagtcttgctctgtcacccaggctggagtgcagtggcgtgatctcagctcactgcaagttccgcctcctgggttcacgccattctcctgcctcagcctcccaagtagctgggactacaggcgcacaccaccacgcccggctaattttttgtatttttgtagtagagacggggtttcaccgtgttagccaggatgttcttgatctcctgacctcgtgatctgcttgcctgggcctcccaaagtgctgggattacaggcgtgagccaccgcacccggcctgctacacatttttaaacaaccagatcttgcaataactcactcactcacacaacaataacagtaccaaggggatgtcgttaaaccatttgtgaaggaccaccctcatgatctagtcacctcccaccaggccccacctccaaccccagggattacaattcaacatgctatttaggcggggacacagatccaaacaatatcttcctctcacgtagctgggactagaggtgtgcgccaccaagctcggcctctggtttttcaaatgatatcccaaatcggagctcctctcaccacttccactttgccacttttattcaagccactagccaacaacgtgggttatgacagaaacagaagcctccgcgctcctttcctcctccaaacttgctcaccttgtaggtgactctctatgctgcgggatctgttaaggcttgagtcagatggcaaagtctctgctcgaggccctccgatggtttcccttccaccaggagtcaaagcccaagttcttaccagggcctccgtgacctcactgggtctgccctggttcttctctgggctcatctcctgctgttctgcttttgctcacttcgttccagcctctctggcctccgcgctattccttcaggcacatttctgctgtgtggcttttgcacttgcttttccctctacctggagagctcttgccccagatacccatgagtctccctctctcccctccttccggtttctgctccattctctccatcccagagaggctcttcttgaccactctacctaaaatatcagcttcctgcaataaaatatcaacttccttcactctttattctttttccctcttaattttattatatctcctcctgacatgtatttgttgattctttccccactagaatataagctccacaaaagccgcatctctgctcctctccctgctacatccttagagtcaagcctagtgcctgaccacatcagtgacattggttgaattgaatgaaggatcaataaaggaataaactgaggttgggcacggtggctcacgcctgtaaccccagcactttgggaggccgagtcaggtggatcacctgaggtcaggagtttgagaccagcctgaacaatacggtgaaacctcgtctctactaaaaatacaaaaattagctgggcatagtggggcacgcctgtaataccaggtactcgggaggctgagatgggaaaattgcttgaactcgggcggtggagcttgcagtgaaccaagatcgtaccactgcactccagcctgggcaacagagtgagactccatctcaaaaggaataaacggagctttctatggtaagtatctttgctcatggcaggagcctcactgacagtttcctgagtcacactttccggtttctgtgttgcgtgtacattgaaggcattccaatggtggatctgagcctcaggataattggatatcgcttttcagtatgtagttccacatcatcatttttttggatgcctttaatctttcttcacttcttcttctgtcccatcaccaacatgagcagttggatttattttagggccctttctcacaaaaagcaaagtttcatcactttgtgggagtagctggggacacataggaccaagagagaggagcagaaccatgctgagaggccctggcggtggctgcctctctcgctggctaagggactcagcttcagcacctgcccccagttctgcagtgcacgatttgaacccatccctcagtgaaataacgaatgatcccaatcatagtccttgaggacagcttacaagtgattcatggtgaactcaagaatgccaaggaatcttgtgggtttatttgctccatctctgctttaacctcgatgtcctcccggctccagtggctccgtcatgttctcaactttgtgtactcatggttctagaatcccaacccctggattcctgtctaaggctcagtctcttgctaggaggaaagacatcttatcagatgttaggtgtgagatgtcggaggctgtgtttggtctcccagcattcttgtgagcgaagggcttttagccacattctccctatcgcttgatttctctctcactttgtgggaaagtagacagcaggaccatcaccccagttcaggattgaaaactcagatgtttaactttgcagactcatgatgggtttctctccttggcatgtggtctcctttatttgagctgtatgtgttgaggacctactgtgtgcactagggcactccatgggtatggggaggagcaagacagaacccttgtccctcaagactggaatccagaaaagggtggggataagtgtggcaacagctctggggtaggaagagggacatgggtaagagagaggagagagctgtgactccagctgcagtggggtcagggaaggacttactgttttcataaaaatagcacagatgaaggctgggcatagtggtggctcatgcttgtaatcccagtactttcggaggccaaggtgggtggattgcttgagacaggagttcaagaccagcctggacaacatggcaaaaccccatctctacaaaaaaaaaaaaaaaaaaaacaacccaaacaaaaaaattagctaggcatggtagaactcaccggttgtcccagctacccaggaggctgaggtgggaggatcacttgagcccaagtggcagaggttgcagtgagccgagatcgcaccactgcactccagcctgagcaacagagccagactctgtctcaaaaaaaaaaaaaaaaaaaaaaaaagctcagatgccttgaaaggcaaaacatttagaaaagctacaatagataaaacaaaggacatcccaggtttcctccctgcaaaaccatcattcaagctatgtttctatgtggagtctctagatggagagatagacaggcctacttttataaaatgggatacttttgaaagtaaaagttattagaggtaattttacttaacataaacagaagacaaggaaacaaaaccaaaggaatctgaatcttaaataaatattacattatcaccaatggaattggttcctaaaagatccctctaagttttttttttttttctttttttgagatggagtttcactatttttgcccaggctggagtgcaatggtgcgatctcagctcactgcaacttctgcctcccgggttcaagtgattcttctgcttcagcctaccgagtagttgggattacaggtgcataccaccatgcccagctaatttttgtatttttagtagagacggggtttccccatgttggccaggctggtcttgaactcctgacctccagtgatccacctgccttggcctcccaaagtgctgggattacaggcatgagccatcatgcctggtcaagatccctctaaatttaacaagagattaggaaaaacattgcgattggagttacatagttttttcaaatctttgtattttattataagcacaattaacaatggtattcttctcagataaaatacttaaattaatccaatgataggatttttgagagtaatgtgaatttgttcatcattaaatcagaagacaggcatattctatgaaaagtctgtaaccaagttttccatttgtattagtccattttcatgctgctgataaaaacatacctgagactgtgcaatttacaaaaaaaataaaaataaaaaaaggtttaatggactcacagttccatgtggctggggaggcctcacaatcatggcagaaggtgaaaggcagatctcacatggtggcagacaagagaacagaaattgtgcagggaaactccccgttataaaaccatcagatcttatgagacttattcactatcatgagactagcacgggaaagactcactccgatgattcaattacctcctaccaggtccctcccacaacacatgggaattatgggagctatgattcaagatgagatttgggtggggacgcagccaaaccatatcaccattcctgtccttttctcgtgcacccttcacagatgtgcgcacttagtgctctgagttctgaataagcttagccatgtgtccatcaagatgtggagtggctccatcatccccaacagtctctgcccctgatgggctcctccttcctcacttggaccctggcaatcactgatctgccttctgtacctgtagatttgccttttccagagaatcacataattagaagataatctgtatcagtccattctcacactgctataaacatactacccgaaggctgggcacctgtaatcccagcactttgggaagccaaggcaggtggatcatgaggtcaggagtttgagaccagtctgaccaacatggtgaaaccccatctctactataaatacaaaaattagctgggtgtgatggtgcgctcctgtaatcccagctacacaggaggctgaggcaggagaatcgcttgaacctgggaggcggaggttgcagttagccaagatcacgccactgcactccagcctgggtgacagagtgagactctgtctcaaaaaaaaaaaagatactacctgagactgggtaatttataaacaaaagagttttaatagactcacagttctgcatggcaggggagcccgtagaaacttacaatcatggcagaaggtgaaggggaagcaatgtaaatcttaattctaatgttttcatcacagtatctcatgcctattattggctgtgtgtggtgttccttttcaagtctctggcttcaacgtctgcagggagtaaatttcccacctgctgggggtggggagcaccattacctgactatgcaggctcataaaagtgggtctgggttctaaatgctcatcaaacagactctcagccacttctgttttcagccgctcttgcaccccacctttcagagggattctggttgatgcagagttttgtggctcaaatagattttctgttctcaggttcttcaccctgcaggcacacataggacttaactttctctcatttgctgggccaattaccaatcattcattcactttttaatcttccaaattttgatgacatcttttttttttttttttttgagtcagagtcttgctctgttgccaggctggagtgtagtggcacaatctcggctcagcacaacctccgcctcccaggttcaagcaattctcctgcctcagcctctcgagtagctgggactataggtgtgcaccaacatgaccagctaatatttgtatttttagtagagatgggatttcaccctgttggccaggctggtctggaactcctgacctcaagtgatccatctgccgcggcctcccaaagtgctgggattacaggtgtgagccaccacacctggctctgattgctttcatatctttgtttttcttaatatctattatctgtctattcataattccattttcagcagggtctcttctgattttgacatttatcattaatttgggacttctgtaatgttatttgatttcaatttgtttccttaggtctctcttttgtgtgtcattctgttgtttaatcaactgatctttgaaagtttgttttaccaaattcctgttcttgttctgtcgttttatagcagagagcacctatgtgaagttttcttccagttttggggttatatctccttctaggctggattctttgtcttttgggtgctttttttcttgggggttttggtgggagtgtgtgtgcatagtttccatcagtttcttacttgtgtgtgggcatttctgttcaaatattctttttgctgttatacagtgtgaacttggactcatttctcagtgtgtctgagatagattttgccatagtttgaggtccagatattttttgttcttaacatttttcctttagcctgggatcatggtgggatgaggggtaggaaagtggaaaagcatattggggcagtgcatatttctggaagaaatatgttctcacttctgagggtgtgaaaatgtgctaggattgcacttccctggggagaaagatagcttccctttagaatgtgggatagtcagctgggcatggtagcacacacctgtaatcccagctacttgggaggctgaggcgggaaggttgcttgagccccaggaatttgaggctgcagtgagttgtgattgtgccactgctctccatcctggatgacagagcaaggccttgtcccttaaaacacaaaaactcagacgcggggtgatggctcacgcctgtaatcccagcacagtgggaggctgaggcgggaggatcacttgaggtcaggagtttgagaccatcctggccaaaacggtgaaaccccatctctattaaaaatacaaaaattagctgggcatggtggtgggcacctgtagtcccagctactcaggaggctgaggcatgagaatcacttgaacccaggaggcagaggttgcagtgattcaagatggtgccactgcactctagcctgggcaacagagtgagactgcgtctcaaaaacaaaaaccaaaaccagaacgcaggatatttaatactcattgccccagccttgttggggaggggcacaataagaaaaatcccatctggcatcctgaaacaaatcagtattggggtgagcccagtggggcagctgatggctgagtcaggctggtgcgatggaaggagctgtgagggccccgtagcttggagcatccctggtccccttagcagccatcataagacggagcaggcagggctgtagttggacagcccagtcaggaaatgccagccatgaatgagtgccccatggctgccttgggaatgtgtgccaggattggaatcctgcagttgaggatctgaaatgttctgaccaggtggctaaagagtatgacttcaggccgggcgtggtggctcacatctgtaattccagcactttgggaggctgaagcgggtggatcacctgaggtcaagagtttgagaccagcctggccaacatggtgaaaccccgtctctactaaaaatacaaaaattagccaggcacggtggtgcacgcctgtagtcccagctacatgggaggctgatgcaggagaatggcttgaacccaggagacggaggttgcagtgagccaagattgtgccattgcactccagcctggatgacaagagcaaaactccttctcaaaaaaaaaaaacaaaacaaaactgtgacttcataataaggtcatgttgctagggaccacgtattgacgtttctagggagaaatgagaaggaatacagcaaccgaataagacgatgttcgtttatgacatccatgatgtctttcaaggcttgagatacactgtcttttgtctaattagtcattgtgaccatatctccatggagaccattatgtttgtactcacaatagacacgtgtgcatccattaaaggaacacagttgccaaacgtacgctctgggcccagggtggagtggctttttacagcacagtcatcggagctgctgcaaaaagtgtcagaaaacaagcaaggagctgtccttattcatgaagagaggctctctctggtatcaggccctgggtctaggggagtgtgaaacccaggaaggcggggtgcacacgctcatgacaaaagttccaaaggcgtagattcactctcttttttttttttttcaaatgtgtgccaaagatttttaagctcattaattaatgaagggaccagtaagatgttaaaaactggctcaggagagaatgcagagaacagacattaatataggtaattaggaatgttttggtcaagagacacaaaattggtttcttccaagagcagtaaggagaatggggagaagatttagtctttcattaaaaaaatttgagagccaacaagtgctcagtagagtgagtggtgcttggacggaggggtggacaggccggatgggactcaagcgagactgtgctacccagacctgggcagtgctccagggatgcttagcagaggggcaggaggctgtgggggatgccgctgtctgggccttgtcctttttgtgctaagcatccccagctccctgcacaggccccaaatgtggtaaatgcatggcagaccttggggcatgaggggatgagaggggaccttccagaagagtagagtgggaacagaccatgaaagcttgggattgcagaccctagctctgccatgggacaagaaaccagtccctctcagataccattcggcactcgtttctgcctcagaactgagagcagcaaagggcttctgtgtttgtcctgctcctggcttcttttttctttttctagagacagggtcacgctctgtctcccaggctggattgcagtggcacaattgtagctgactgtaatctcaaactcacttctgggctcaagtaatcttcccactccggtcacctgctaatttttatttttgttttttggtagagacagggtcttgctatgttgcccaggctggtcttaaactcctgtctctagtgatcctcctgagttggccccccaagatgttggattacaggcgtgagccactgcacctggccttctccttgctgccttgtccaatgggatttcgggactcatgtgacttcagctaccttgtttgtactgaccatcatcactaactacagaaatactacaaggccgaagctctcaagcccctaacctggtagttacaaagggagaagtttcctaagctcaccagagtggcacttgacctaactacacacttctgcctggactcaggaagcaaactaccatggacctcgtcacccgtaatcacatgcacaggcaggcacttgctcatggccattttcttttgttttgtacacaagtctaataactccactatttttagtaaagtgagagttgatggcatggctgttggtaggcacatggacaccagcaggagggagtagctggaagcctgtcagtgaggtcaggaactggagaaatatcaaagcaattacacgaggccaggatggcatgctggggccgctcaatgtcagagcacagagcgctctactctggcctagcgcagccactgaccgttcttagccatagccttgagtcacccaggaaagagcttaccaacaaccaagcaggagctttgggatcataaagttctgggttcaattctctgctccctgtttgcagggctctaggcaaagagtctccctcttttgcccaggctggagtgcaataccacaatctcagctcactgccacctctgtctcccaggttctagtgattctcctgcctcagcctcctgaatagctggaactacaggcgtgagccaccatggccagctactttttttgtatttttagtagagatgggatttcaccatattggccaggatggtctcaatttcttgaccttgtgatccgcccgcctcggccccccaaagtgctgggattataggcgagagccaccacgcttggcttttttatttttatttttttaaagacagagtctcactctgtcacccaggctggagtgcagtgatgcggtcttggctcactgcaatcctgacctcctgggttcaagtgattattgtacctcatcctcccaagtagttgggactacaggcacgcaccatcacacccagctactttttgtatttttaggagaggtgggctttcaccatgttggctaggctggtcttgaactcctgacctcaagtgatctccctgccttggccttccaaagtgctggggttacagacagtgcctggctggtctaggcaaatcacttttaatactgctttcatattagagtgttgggaggattaaatgagtttacagagcacatagtaaatgctcatgaaaaattagccgctattggcagggaaatgaatgatggtcaacgacatgcaacaacatggatgagcctcaaaatcattctaatgacaggaagaagcaggcacaaaagggcacttaccgtccagtttcattcatagaaatcgcaaaacaggcacaagtcatctgtgatattagaggtcaggatattggttatgggggtttgccatttttgttgtaaaatagaacagatagaaataatgcagcagggaggtgaattttgaaatattgtatatttcaaaatagccaaaagaggattttaagtgttcataccacaaagaaatggttaatatatgaggtgatggatatgccagtttaatacccttatttgattattctacaatgtatacatatatcaaaacatcacattgtaccccataaatacatacaattattatttgtcaattaaaaattaaataacagccagtgtggtggctcatgcctgtaatcccagcactttgggaggctaaggcaggaagattgcttgagctcaggagctcaagacgaggctgagcaacacagcaagacttgtctctactaaaaataaaaaaaaaattggctaggcacggtggcacgcacttgtagtcccagatacttggaggctgaggtgggaggattgcttgagcccaggaggttgaggcttctctgagccgtgatagtggcactgcaccacaacctaggtgacagagccagaccctggttcaaaaaaattaaataaaacattgaaaagattacataagataaacctgctgcagtttagggaattactgtgaggctacccctgaagctagtcctgatcacagtcttcttcctccctctcaatattttgtttcttgatctgagtgttagttacccaggggtgtttatgaaaagtgggggagcagtacacttacgtgcgcttctctatatgcatattatgcttcaataaaaagcttaaaattaggccgggtgtggtggctcacacctgtaatcctagcactttgggaggctgaggcaggcggattgcctgagctcaggagttcacaaccagcctgggcaacacagtgaaatcccgtctctactaaaatacaaaaaattagccgggcgtggtggtgtgcgcctgtagtcccagctactcgggaggctgaggcaggagaattgcttgaacctgggaggcagaggttgcagcaagccaaggtcatgccactgcactccagcctgggcgacagagcgagactccgtctcaaaacaaacaaacaaaaagttagcacttattatttttcttaatattattatcaaattaacttattggagctttaaactcttcatctgtctaatggggttgattaccccattttttgcagaattgttagaagttacagtattcacagcatattcgttggttcattcagcagatatttactgagtgcctgcaggctcgggcactgttctaggtgctggtgataaagacgtgatccaaacagacaaaaatcatggggtttacatgctggcgagggagagagacatgctaggcactcacagagaactatgaaatttggacagcaccctctggttcagaaaataagatcctggaccacatctctatcccatatggtgaagtttgtttggtttggttttgatttggctccttaaataattagcttcactattacaaaatcttggttagcacaaagtcagatgagtgaaagtgtgtggatgctacataaacaatgcctgccttttctagaatttctaggtgcaatcaaattgcgaattagagcaaaccacccgtcataagccgctgcgttgaggaccaaggaatgaatagcccagcaaagaaatgctttctctctcctgttttgaggaactcgggccctgttttgaggccctgcaccctgcaggcaggaaagcgttaagaaagaaatgtgcatttccactgaacaagaaaatcaacttagaaaagaaatgtgtattggaaaatatctatttgcctgcaaaataatgtaaaaataatgagctcctattcccctttgatgtgcagcgcacgcttttaaggaaagattctgcatttctgagatactgggcctggcgtgtaatgaagtggttgttatggcaacaactttcaaaagcaagtattttctgagatgtgctccacacagccagcgtgagagaggaaaacatgaaaacagagacagggagatgagctaaacagaaggcattagatgcggagagcatccgctccaggtccaagggggaagaaaagtgcccgctgcccccactttcccagcctggatttgcaaagctgcaggggaagacagacccctgccctggaaggggccccttgaggaatggagctgggacaaggcaaggttggggctgagacagtgtgagactgtggagagtgataggcggcttgagcctgggggctccatcaccagtccctcaccacggccccctcctcccagcccgactccagcctcagcctctgcccctcccagcctccatgctcttcattcattccaggtaccagtcttcccactggcagtccgggccttctgcccattccaccccatcatgtgcctggggttcctgccaggctgggcatagcaccaggagccggcattcatcaccctctttgctctgcacagcaaccccaagtgcctggcaaatagtagctgcccgatctctatttgtggagtcaataggtggtccttctctgacagctactgctattgtccccattttgttggtgaggtagttgaggcttggagatgttgagtgatttgccccagccctgcaggcagcgggcagtggagctgggctgcccccacccctgcatcgtgctgcctctcagtaccccgatcccagcctccctgtctttgttcatactgtgtctctgcctggtgcaccctctcttgtctcgtaagacctgacccaaaggccatcctgtggccatgatgtcatgaaaatgctgcctctaaatgagactcctggatgtgtcagtgtctggggatggggtcctcactacctgctagggagtctgggctgggcacacatgtcctggcggctgggaactgccaggaagagagccgcctccagagggaccgtgtctgtcccattcaccatgctcctccccatgcaatgccgggcacagcggtgacactcaggaacccttgggtgaatgagagactttggaacgcagacagtttggaaaggtcctggtcggtcaggttttggagatctttggggctgccccagccaaagctttcttgtgattggataacctcctcaaacgcagcccaagctcatatttgacagtgatggtgaggaggggtgcatgtgagtgtgtgtggcatgtgagtgtgtaaacgtgtgtgcatggccttgttggaggtgatttgcctgaaaaaggagtctgggctacactcgtgtgtgcctctgtcaggggtgagggagatgcgtgtgtgcacagatttgaggagatctgtctaaaggggcatgcatctcaatatgtgtgtttcaggagcaggtagtgtgtgtgtctgtgtgcgtgtgaatggccttgattgacaggacttgctctgtaaggggtcgtatgtttgtatgcaggtgtgcctgcatgagggtgtgtcttgtgtgtgtgcacctggtcttgatgtatttgtgtgtgtgcatgtgtgagagagatgagcatgtgaaggagtgtgcttcaaagagaggtttgtatgaacgtgtgtgtatcaggggtgtacctgggaatgtgggtatagatgccggggaagagcagtggatacattcctggctgctgcatttgtcaggtagagggagcctgttgaagtaaatgggctgtatttttggttctctgctgcgagagagcttctggcagctgtgctggcaaacctgtgagtcacagagagagaactatgccatgatgctgtcctctggatcataaaatgtaagttagagccagaagcagccttggcagtcacctagttctatcccttgtgttacaattgatggaaaacagagaagggaagcaaattctccagatcacacagcgaactcaggatagagctggaacttggacttgtgtctgggtctgggacttcccaatcctccacttcctgctgccaggtccctgaggaggagagagagggttaaccacagagtaattaataccaggcaccagagtattataaaatttcatttccactttaattaggggaacttaaaaaaatagaagtctttgttgtgtcaattagttgattgactatcgttggtttctgggttagggaaacttgatctgcagtgaatgaatttgtttatcagggaaaaggagccagggggtggaaagagaaattcaattaagtgtcaggctgctaagtgacaggctgcatttgatagaacttttagcttaattgcttgtatttcattaagagttttatttatcaggagcattcttcatgttaaaaatctcaggtggtgtctgcgtggctttgggctatttttctgcattgattaaggacattgaattgtggacctgaagaattacctgggacctcagagacattcttgtccgggcaaaaaccgtcctttatcctagctcccggggcttgtgtccccctcatgcctcccctcccatagttatatccaaagtttagtaagtgttgcatttctctggggagaataatctgtatttcttctttagatttgcaaagggataggagttgcatagacaataatactcagccaggctgaccaacttgtttggttttgctctttgttgttgtttttcttccccataaaaacacatttaattgcatgcatagttgtaaaattgtacatgaaggcagtgctagaaactaagttactattactttgcattaacaaaaatgactgtaaaaataactatccttgagaagaaaatgagcctgacaagatttaatttaattagagatatgattactatcagggttttccaagaatgtcatatcagctcaaaagtagatgcattttattataaatcaaatgggtcctggtgccccagaggtatataaaaaatatacagcgtggcttacttgagttattcttttctgaaggcctccagacccttcttgtgaggagaactgtccaatgcataatctataatggctatagaaagggagggaaggaggcagggagggaggaagggaggagggagggagggagggagggagagacaacctgctgagccttggggctctatcaccagtccctcaccatggccccctctggccatctgtgtgcacctgtggtcccagctactcaggaggctgaggtaggaggatcacttgagcccaggaggttgaaggggctcacttcaatcccctctgggcctctctgagcctcggttctctcatttataaagatgaccacttgttttataagtgagagaaccaaggctcagagagggccagaggttttccgaaggacacacagctagctatgggcagaaccaggactggcacttgttcttcctgcttcttttccaagaacctggctctgtgtggggcctctgagttgctgggcttaagtccttcagggacagttcagcggggcagccatttcttttccttttgatctattagggcaggagaacagagtggttaggactgctgtcaccacctgggcttaaattctggatcttctgcttgttttgtgaacctggacaagtgctttgaccacactggtaaatgggatagtaagatcatctgtctcacttggctgtcaggaggatcatggggtactccatgtaatgcacttagactatacctggtacatagtaaatgctcagtaaataccagctataattattattgagcttccaagtaagatttcatttgaaaaaatgttcctatttttttttttttttttgagacaggatctcactatgtcactcaggctggagtgcagtgacacaatcacagctcactgcagcctcaacctcctgggctcaagcgatcctcccacctcagtctcccaagtagctaggaccacaagtgcacaccaccaagctcagctaattaatttttctttttttgtagagacagggtcttgctatattgcctaggctagtcttgaacttctgagctcaagcaatccttcgcctcagcctcactaaatgctggtattacaggcatgagccaccacacctggcctctaattcttaaaaataattgaggagcattgtgctggactaagtagctccctctccaatcagttcttaagaagaaataatttactccaggagatgggtggactcagacgtggtccatgatgagggctggggaaccgaggtttcctaccactttgagtttttctcttcctggcactccctttggtccctgattatttttcttttcttttctatggtaaacatctattctggctctattctcttcctctttcctcttccccacctttcctgtcttatctctccctccctccgtccctcccttcctcccttcctgactccctccctccctcatttccttccttcttccttccttccttccttttttccttccttccttccttctttccttccatccatccatccacccacccacccatctgttgggtgtgggaggtggcttctacagtctcttaagagctgattgtgcctgtctgtttctgactctgcatttaatgatgtcacttggtggcttgacatcagccatggtgggaacgtttacgccatggaaattggagaacactacaaataaaggctttttttgggattatttgtttgctattttgaaaactatttttcagcctactgtttcatccatccatccctgtatcatgcatccctttctctggatgtccagacatccaaccaccaaaccatcatccgttgaaccattcattcatctgacatgtattaagcacttcttgtgagccaggccctatacaagctccactgggagggcagaattggccggagcctgctccctgcccttgaggaattgacactttagtggaacagacaccttacacactcaaggactgtcctggacatcatctcatttgatggtcatggtcggtattgttatctcagtgtaacaattgaggagattaaggctcagagaggtgaaatgaatggcctgaggtcacacagctggctgtccattcatttgtttactcgtatgacaaggtttacagaggtgcttaaatccagccagatgccaaggtgaaaactgattttcaaacctgtccttcagaaataaaccttcttaaaaaaataaaaagaaagaaaataaaagaatagggaaagttatttttccatcttgcttagatggggacagttttgaatttatttttttcagattgaacaatcgttcctcaaatggatagtgataggtgatctaaaaaataatctttaaaaacgtcgccgagttgggcatttcctctgggtgacataactcagtgtgacagaatgcatttaaattcacagaaaagaaatggcaaggagtgcaatgtggaaggtgtttgtgtggctgccagctccttaaccctctcctttcaccattcttccccctttcctccactgcccctgggcctgtgggcacattcgcttccctcactgcctccagccatatgtctacacatacacatacgcatacgcatacacacacgcatacacatacacatacgcatacacatatgcatacacatagcagggatcaaaagcacttctgaagatcctgggtcccagaatgtgggcagctgataggctgggggaagagggtgtgggtttcctaatgggccaaagaaagaggtgccaggaatgcgtggaagatgatgtctctcttttctccagattcctgtctgttcccattgtatttccattcctgcacatggccaccatggtaacaagggaagggctttgctttgggaaggccagggccaggccaggtgaggctcacggacaaagcatctgctggtaacttagattcagcgtgcgaggaaaccatgctacaattcctccctggcttggtgggtggcctccctgtaagagacagaaccccagggccatgctagggttgcagctgagagtgtggatggcagcatggtgctcaaggtgctagagtttcttctttgtgatattttagttgtacttcccaaggtatgttccattatttgcacactggtttctagtttctggcattctgcatctgccattatggctgggaagaaagaagagagtagagaactccttagggaggagaaagaggatctgatggagaggatgtcttaagtcagctttcctagatggagattcttgcagaatttttgcagagagtaaattattgcagatggggagtgaagggagctggacatggtaggggaaggacctgaagctggagatcagctttaacctgatccacaggaagctctggagtgtgaattgtaccacagattggcccctacttgaggccaggggactggcatttgtacttccacgtcagtcactagctactggttgccactggtggggatgggagtgagaagagagtagcttccaagagggggcagatctgccaaagtcaagtctctgggaaagggaacagggtgagccttcaggactcacaagacccaggggctggggtactagtctgataaaaggggtgttatggtttgaatgtgccccctaaatttcatgttgcggaaaccaaattcccaaatccatatgttgattggaggtggggcctttgagagataattaagatgagataaggtcatcaggctggggcacccataatggaactggtggctttacgggaagaggaaacctgagctggcacactccctggctctcatcatgtgatgctttcaccacattatgacacagcaagaagggccccaccagatgcagcccctcagccttggatttcccagccttcagaactgtaagaaatacatgttttttcttaataaattacccagtcccagatattaagttatagcaacagaaagtggaacaagacagggtgtatgggttgggaagcaacagctactacaaggagaacctcaataagacaggataaagggagaggagggactgtttccttccctgccctgggggactgtgggaggaattcagcagcaaggaggaggcactcttcactcactgcaaaagttcacagaaagccctcttttaataactgggtgccatcagcaggtaggggaagaaacttgaaagacacattcatgaaagagagaccgaggtgagagatggtttaaatacttgctgctttgagtaaggctccaggaccagcatcaccatcatcacctggagcttgtccaaaatgcaggctctcaggtcccacctgaggctactgaatccaatccgaaattttaacaagattcccaagtgatttgtgtatacacttaaagtgtgagatgttctccttagaaaaaaggtattacaccaggaaatgtgcctcttggctggacagacagctgaagagtagcacaatatcttcattcgtttattctctgttctttattttgtttgttctttcaacccatcactgtattgaacatcagttttccaggcaatgtcctagggaaacaaagcttcctgcattcctggagcttgctgtctgtgggggaaagcagacattggccataaaataatacacatagtttattacaattgtcataagtattacaaagaaaaagtacaggtgacaataacagcataacacagggaagctgacctggtctggggcttacggaaagcttttctgaggaagcaacattgaaaaatgggcgacagccatgttctaggcagagggaagagcccatgcaaaggtcctgaggcaggaagaagctctgagactctgaggatgttttaaaaaattccagtcctggccgggcccatttgtccacacctataatcccagcactttgggaggctaaggcgggaggatcacttgaggtcaggagtttgagaccagcctggccaacatggtaaaaccccgtctctaccaaaaatacaaaaattacctgggtgtggtggtgcgcgcctgtagtcccagctactctggaggctgaggcagaaggagcacttgaacccaggaggcagaggttgcagtgagccaagatcatgctattgcactccagcctggcaacagagtgagactcagtctcaaaaaaaaaaaacaagaaaaaactctcagtccttgctgtggacttgagaagaatgaaagagagagaggagatgggatagagagatggaggcaggggtgcaaccctgcaggcccttgcatgcattataaggattttggacttttatcttcagagcagatggcatccttgagaagaatgcttagtgtaactcataagagcgtgaactctgccactcactagctgtgagaccctggatgggtggctgaacctttcagcatcttgatcttctcatcggtaacagaagaacaaactagtgcctatgtcatagggtggtttttaggattaaatgagttgctatatgtaaagggcttataacagtgaatagcacatgagaatttacaatgacagctgaagggtttttttttttttttttgacagagtctcgctctgtcacccatcctggagtgcagtggtacgatcttggctcactgcaagctccgactcctgggttcatgccattctcctgcctcagcctcctgagtagctgggactacaggcgtccgccaccgcgcccggccaatttttttgtatttttagtagagacggggtttccccgtggtctcgatctcctgacctcgtgatccgcccacctcggcttcccaaaccgctgaagggttttcatcaggccaataatgtgataagatttgtggtgcttcaagaaatcactctcactactgcacaagggaaactagactgcagaagagacactagactgtggaagggaaagtagagtgaaggcagagagaccagtcagaagattacagctccccaggagtaggatgatggcagctcagaccagggcagaagcagtggatgtggaaagaggatggatgaatagacttggtgaattgtcgggtttgtgtgctagggctgggggaagggagtgggcgtgaggcagcagaggagtcgaggatgcttccaaggtttctagtttgggcatcttggtggttggatagccagttttttggtggaaggtgatgaattaaattttggacatgctgaatttggacatgtgagatgttaaaatgaagatattgaacagggagacgagacgtggggctacagataaaaatttaggagccactaacctaaagatgaccaataaaaccatgggaagaggccaggcaccgtggctcatgcttgtaatctcagcactttgggaggccaaggcaggtagatcacttgaggccaggagtttgagatcagcctgggcaacatggcaaaaccccgtctctactaaaaatacaaaaattagctggttggtggtgcacgcctgtggtcacagctacttgggaagctgaggtgggaggatggcttgagcccaggacattgaggctgcagtgagttgtgattgtgccactgcactccagcctgggtgacagagccagaccctgtctccaagcaagcaaacaagcaaacaaacaaacaaaaaacaccacgggaagagatgaaactactcagaaacagtacatggagtttggagtttggagtcctatagacttgggtctgaatctccccaccagctagccatatggttttaggcaagttatttagcttctctgataatcagtttttaatctgaaaaatgagaataattatacctatacccaagggttattgtgggaggtaaatgagacaatatgtataaaacacctggcacggagctcagtcaatattaatcacttttcttcttttatccttccttcctcactcatcacatacatttttttctaccttggtttctaaagccttctacattcgagtacaccaggcctgtgttcacctgttacccaggtgctgaacccaatgtagtgcatgtccagattggaacctggctgccccaggcaagggtgccacacacaggagagtgagtcatgttgtgaaatgaacactagtcttcaggtcaagtggaccttgattcgagtctcatctctgcttcccacttgcttgggatctcaggtaaatcaatgcacctgccagggcctcaggcattcatctgcaaagtgaagcatcaggtgattctgctctgtattaatttgctagggctgcggtaacaaagtgccacaagcggggtggcttaaaacaacagcctcggccaggcgcggtggctcacgcctgtaatcccagcactttgggaggctgaggcgggtggatcacgaggtcaggagatcgagaccatcctggctaacacggtgaaaccacgtctctactaaacaaaatacaaaaaattagccaggcgtggtggcgggtgcctgtagtcccagctacttgggaggctgaggcaggagaatggcgtgaacccgggaggcagagcttgcagtgagctgagattgcaccactgcactccagcctgggcgacagagcgagactccatctcaaaaataaataaataaaaaataaaaataaagaaaaaacaacagcttcgtattctgtcacagttctgaagactcgaagtctgaagtccgcaggaccatgctcctctgagactctgggaaggacctttccttgcctcttcctggcttttggcattggccagcaatccttgccattccttggcttgcagctgtgtcactctagtctctgcctctgtggtcacatggcatcctcctcttgggtgtctgtgtctcttctcttcttataaggacactggtcatattggattaagagcctaccttactctggtatgacctcatcttgactaattatatctgcaatggccctattcccaaataaggttacattctcagttactggggttaggacttcaacctatcttttttgggaacaacccataacatactcctagtatatttttttcctttaaatctgtagaaagtaagaaaaaaaatctctccagagaaaagaactgtggaacgttaattatattttcatttgttgttagaaaacagttttctgactccttggaaatatgtgttttctctgttaattatgatctccttgtggcaagtaatcattgcaggtaaaagctctttctcatttagagaacaaacacaaaggcaagagttggaccctgctacatctggggagaagagatttgtgctaaattggaaaatacaacccttttctcccttctttgttctctgacacaatttctttctagggtgggggcattaccgggggtggggaaagtttgctttctctgtttccgttaaactggacctctagaaatcatttgccttctcctgataggggcagcggtacacctttgccttcctgcttcaaggacaatccagtgtctgggtgtgagagactctgatggtctctccatttcataaaatatcttaccggtcaactcccttgaagaagtcatgcctgtggatgctggaagttaataaagggcccatgtccaggaggtcctggtcaccaaaaactcatggccaatcacgctccttaatatttgctcaaatgagttgaaaagttaggtccagacaaaatcctatgcgtggatgtttaccgcagctttattcataattgccaaaactggaaagcaaccaagatgtccttcagtaggtgaatggataaacagcctgtggtatatccccatgatggagcatcactcagtgattttttttttttaagctatcaagccacaaaatgacatggaagaatcttaaaggcatattgctaagtgaaagaaaccattctgaaaaggctacatagtctgtgattccaatgatatgacattctggaaaaggcaaaactatggggggagtaaaaagatcagtggttgccaggggtttggaaggaggcaaggagggatgaataggtggagcaggggcatttttagggcagtgaaactattttgtatgatgctgtaatggcaggtacatgacatttgccaaagcacatagaatgtgccacacagagagtgaactctaaactgtaggctttagttattaataatatattagtattcattcatcaagtacaacaaatgtactacactaatgcaatatattaataataggtcaactgtttgcagggttcatgggagaaggagagggaatatatggaagttctctgtactttctgttcacttgttctgtaaacttaaaacgtgttctaaaaaaaaaaactcttaaaaaacaaccaaccaaacaaacaaagaaacaaaaacccctcacaggtcagtcactttggggaagctcctggggtctataagtgtgggacctcttgggatttcccttgtgaggcagaaggtactaatacctaatgcatctcttcacatctgggtggccttatttcaaccagtgcccaccctgtctaaaaggttatcagctttgagtggagctgcaggcaaaaagaggtcctatagctggtccaacagctgtacaagtgaccccaccacttggcaggcctggtggcagatcagcatgctgtttgtagtctggaaaatcttaagaatcctagcagatggtgctaggcagtgaccaggataaggcaagtgagacgcttgcctggggcacgaaattaaaggggttagccaataagctttagccaccaagattttactattttacaagattttccttaatattactattttaagcaatgctttaaaaaacaatgcaaaaaattcgttgtaaacaaaatatccaaactttaaggtgggatccaaccctgcgcttgtgtaacttggccacactcatctcactcttgtcttggccccatcacatcctgcttcaatgtactattttgagattttagtcatcttggcattaatttttattttaaaaattattttggcaaaatattgtttatcttgatgactgagattttgagcaccttcctttaaattttttgctcaaggcaagtgcttgactcatttcactctagtccaggtcctgcccctatgcctctcaatgatcaggttaatatattcattcagtaaatgttaattaagtgtctaccatgtaggtacttggtagacaacataacttgccccatgggtgtccatcctcctcattccctggtcagcccattgttcaagagacttaccaccatgttgccacagcagtatgcatgtatccgacactaagacttcctgggctgtcccctctgctcagtgctggatgttccagcagcagatgtcttcaccaagtcctcaatgaggtgccatagcacactgaggggatctggtggctggttgattaataggtccccatttgctatggaggggaaacaatttgttcttaccagaatagacacatgtcctggattttcatttccattatggcctggcagcatcaccatccatgaacttgtgaaatgtgtcttcatagccacagtgttcccttgggccacagcaagtgcagtgaggaaatgggcttgtgctcacggaatttgctatttttaccatgcagacatgaagtggctagcttagtagaaggatgaagtggcccactgaagactcagctctgccacctttaatgctgggctactcttgtgcaggacatagtagtatatgctctgaagcagcaactagtatctgatgtgttgtcttccatgaccagaatacatagatcctctcccttgactctgagttgcatctactcggagatcctgaattacaccagagaccactgcttgcccaagtcctgtttctctacccagcagtccagcttcccaagctgcattcctgtattgagggcacctaccatttctcactgtctcctccttctggcagtgaggcatatcccccagacttttgggagtagcttggactctagctttaagatggaggacaccagaaccgggacacttctgttgacctcatggtgctcatgctttcccactagagactctgacatccagatcctctatgtagccccatagtttgctctgagtatgctatgtacaggagtataggttgtgcactgcacaagtccataggacaccattcaaatggaatagatatgaacagtgcccttggagctgtgcaatgcagaaggcttgcccgagcagttaggcttaaggaacttgcaccaacatattgaaggaagggggcatggcaaagtgacactggtgcctaaattaatgtggtgataaaacaacaacgacatttatttaatgttttgaagcattgtgcttagccttttacattgatcatctcagttaatccttacaagagctctgttaggtaatattaatatcatcctcgtattacagatggggaaactgagactcagtgaggttgggtagcttgccaaggacacacagctggaaagtggtagagccaggatttgaacccaggaaggttaactccccagcctttgcacatgatccagcactggttgtattgctgacttcatttcaagactgggagctggatccacttctcagaagaacctaagaccttgccaggatcctaaacacgttatgggggaaagagatttagaactaggcaaatgtggatcaaagccatgcttcaccatttaccaatgcaactttggcctcatcccatcatctctctgagcctccattacctgttccaatttgcctgtaattgctagaaggtattgcacacttactggatgtcaggcacagctaagaactttaaccacatgacctccttcagccctttctgataggaccctggcctgcagggacatccacttgagaacatgtgttaaaaggactttcaaagtatcaccatgtgatatggtttggctctgtgtcaccacccaaatctcatctcgaattgtaatccccatgatccccacatgttgagggagggacctgtaggaagtgattggatcacagggatggcttcccccatgctgttccagtgataggagggagttctcgcgagagctgatggttttaaaagtgcttggaagttccccctttgaagcattctctctcctgccgccatgtgaagaaggtgcttgcttccccttctgccatgattgtaagtttcctgaggcctccccagccatgggaaactgtgagtcagttaaacctcttacctttataaattacccagttttgggtatttctttatacagtgtgaaaacagactaatacaccattccatgcacacatgttcgttggcaagagtgacagttgctgagtctactgagccctgacttacacgaggtgttctgctaagtggttacatgcagcatcttggttacccttgcagttactgccactttcagaggcatctgaactgaggctcaaagatgtgaaataacattctgtgggccacaaagctaacaggtggtggggctggtttttttttaactgagtcaggcttattgcaaagcccatgctcttaagtgttgctacccaaaggcctctctggatggtctttcctcacggggccccttctcaaatgctggagattaatttaaatgccaatttgataggtgaatgatggtatctcaatattttaatctgtgtaatgtagatttccaatggtattaactttgctctgtcacccaagttgaagtactgtggtcactgcaacccaggtccctgcatcctgtctcccgagtagctgggactacaagcgtgcaccaccacacccagctatttttttttttctgtaaaaaatggggttctgccatattggccaggctggtctcaaacccctggcctcaagggatcctcctgtttctgcctcccatactgctgggattacaggcatgagccactgtacctggtagcaattaactacttcttcttctttttttttttttttaaagcgaaatcaagtttattaagaaagtaaaagaataaaggaatggctactccataggcagggtagcctcgagggctgctggttggttatttttatggttatttcttgatcatatgctaaataagaggtgaattattcatgagttttccgggaaaggggcaggcaattcctggaaccgaggattactcctctttttagaccatatagggtaacttttggatgttgccatggcatttgtaaactgtcatggtgttggtgggagtgtcttttagcatgctaatatattataatttgcatataatgagcagtgaggatgaccagaggccactttcatccccctcttgcttttggtgggtttcagctagttctttaccacatcctgtttatcagccgctctttgtggcctgtatcttgtgccaacctcctatctcatcctgtgactaagaatgtctaacctcctgggaatgcggcccagcaggtctcagcctcattttacccagctcctattcaagatggagtcgctctggttggaaccccctccattttacaaggcgattttttttttttttttttttttttgagacagagtttcactcttgttgccccggctggagcgcaatggcccgatctcacctcactgcaacctccacctcccaggttcaagtgattctcctgcctcagcctcccgagtagctgggattacaggcatgcgccaccacgcccagctgattttgtatttttagtagagacggggtttctctatgttggtcaggctggtcttgaactccccacctcaggtgtcccacctgccttggcctcccaaagtgctgggattacaggtgtgagccactgcgctcagccattgcaaggggattcttaatcctaagggttgcagagggacgaaggtacatcttctgcagcttctttaggctgaataggggccacgatattcctgcttaactattagggtctctcgtctccagggtagagaggcgctcagtcagacagcattggtatgctgagggccattcataactccaaaatttcaacaaaaggtgatatccaaagtcgaccaattggtgctgcagtctatttcctttgggtcagggttctctccagtattgtccctttgaggtttgctaggaagaggttactggaaagggattctgatctagactccaaaggagggttcctggatctggtgcaagaaagaattcagggtgagtccacagaggaaaacgaaagcaagtttattaagaaagtaaaggaggcagggtgcagtggttcacatctgtaatcccagcactttgggaggctgaggtgggcagatcatgaggtcaagagatcaagaccatcctggccaacatgatgaaaccccgtctccactaaaaatacaaaaattagctgggcatggtggcgcacgcttgtagtcccagctactcgggaggctgaggcaggagaatcgcttgagcccaggaggtggaggttgcagtgagccaagatcttgccattgcactccagcctggtgacagagcgagactccgtttaaaaaaaaaaaaaaaaaaagaaaagaaaatggctactctgtaggcagagcagccatgattaacttcataatgccttttggtcattcctattttaactcctgtggattgcaaggtcgtgtcttttgtccatttaaaaaacgggagtagggtgttgtcctcttcatattgatggagaagaaattttagatcttatgttcttcattatatgacaaatagtattttttgaattttaattttgtttgtggtgcttcctgatacacagaaggtaggcagatgactatagtcaatatatcagtttttcttttttgagtctttccttttgtctttttctcctcttgcttgaaaagtcatacttctcttgatatcagaaaaaatattaatctatattttatcctagtttttcatggcttcattaaaataatagctctttgattgatttgaaatttattttattttattttattattattatttttgagacagagtcttgctctgtcacccaggctggagtgcagtggcatgatctcagctcactgcaacctctgcctcctgggttcaagcgattctcctgcctcagcctcccacttagctgagactacatgtgtgcgccactatgcccagctaattttttgtactttttgtagagatggggttttgccaggttggccaggctggtctcagactcctggcctcaagtgatctgcccgccttggcctcccaaagtgctgggattagaggcgtgagtcaccacgcccggttgaaatttattttgatatatggtatgaaacgctgaactttttcctgccccaaattgttaacgaattgttcctgcattatttattgagcaccccagaaaattccccagtaattaattaattattattattattattttttttgagattgagccttgctctttcgcccaggcaggactgcagtggcgcaatcttggctcactgcaagctccgcctcccaggttcacaccattctcctgcctcagcctcctgagtagctgggactacaggcgcccccacggcacccagctaattttttgtatttttactagagacagggtttcaccgtgttagccaggatggtctcgatctcctgaccttgtgatctggccgcctcggcctcccaaagtgctgggattacaggcgtgagccactacacccggcctaattaattaattattttagatggagtctccctttgttgcccatgctggagtgcagtggcacgatcttggctcactgccacctctgcctcccgagttcaagcgattctcctgcctcagcttccagagtagctggactacaggtgcgtgctaccatactcggctaatttttgtatttttagtagagacagggtttcaccattttggccaggctggtcttgaactcctgacctcaagtgatctgctttcctcggtctcccaaagtgctgggattacaggcataagccaccgtgcctggctgaaattctccattaatttaagtgccactttaatcaatactaaattcctgtgtagactcgggatggttttcaggcttattctttcatagctatgtctattctttgacactgctttaattattataattttacaacccattttatatctggtagatgaaatccattatttatatttttgaaaattttctttattatttaacctcttttattttccattcaaactttagactaatatttttaacttgtagaaactttgtagccagggcgttttttgctttttttttcaagatggaattttgctcttgttgcacaggctggagtgcaatggtgtgatctcggctcactgcaacctccgcctcccaagttcaagtgattctcccgcttcagcctcctgagtagctgggattacaggcatgcaccaccacacccggctgattttgtatttttagtagagatggggtttctccatgttggtcaggttgatctcgaactcctgacctcagagatctgcccaccttggcttcccaaagtgctgggattacaggtgtgaaccactgcgcctggccttttttttttttttttttttttttttttttagttggagtctcgctcttgtcacccaggctggagtgcaatgtccagctctcaactcactgcaacctccgtccccaggttcaagtgattctcctgcctcatcctcccaagtagctgggattacaggtgcccgccacctaatttttgtatttttaatagagatgggggtttcactatgttggccaggctggtctcgaactcctgacttcaggtgatccacccgcctcagcctcccaaagtgctgggattacaggcatgagccactgcgtccggccctagccaggtttgaattgcaattccattaaactttcatatgactttaagcagaaataatccatttgaaatattgttttcttttccttgaatatggtatgttctctaactgtgcagatctttttttatattctccacaaagttttgtcactacttcaaatacttctgcatatatcttttttttttttttgagatggagtttcacttgtctcccagggtggagtgcaatggcgcgatctcggctcactgcaacctcctcctcccaggttcaagcgatttttctgcctcagcctcctgagtagctgcaactacaggtgcccgtcaccacgccctgctagttttttgtatttttagtagaaatgaggtttcaccacgttggccaggctggtctcaaactcctgaccttaggtgatctgcctgcctcggcctcccaaagtgctgggattacaggcatgagccatcacacctggccctgcatatatcttaaacattttatttgtaggttaaaaaaattaatcaatcaatcaatcatttatcaatctatcatctgtcaactgggatcatctcccaggagacatttgacaatctctgggcatatttttagttgtcacaactggaaactagctattggcatctgttgggtagaggccagggatgctgctgtacattgtacaatgcccagggcagcccctacacacaaaaattattagtgtcagatgtcagtagtgcttacattaagcacctgtcatctggcctggtgtggtggctcatgcctgtaatcccagcactttgggaggctgaggcgggtggatcatgaggtcaggagtttgaggccagtctggccaacgttgtgaaaccttgtctctactaaaaatacaaaaaattagctgggtgtgctggtgtgtgcctgtaatccaagctacttgggaggctgaggcaggagaatcgtgtgaacctgggaggcggaggctgcagtgagccgagatcatgccattgcactccagccgacagtgtgagactccgtctcaaaaaaaaaaaaagaaaaagaaaaaaaaaagaaactgtcatctatctatattgtgagtgaagtcttttccccacggattgtcctactgacatagctatcttggtcagtaacagaggagatctgttaagcgtgtgaggggttggtccatgttctctgggtgtttgctccaagccctgggaggagcagcctcctttgagaggcagcatcccttgacttccacagagcccaagaacacgatggtgtgtggcccttgaccgtggctccgcctcttacaggtctcttagagagactaggtgtcccagaggaggtgtcttctggggagagaccaagaagggctgaaagaaaatccatgattccatttaaataaatgtcaagaactggcaaaactcacatctggtgatggaaatcagaggtgtggttgctggggttggggagaggattgagtggaaaggctgcaagggaagttttggggattatttctggcacaatgagcctgggtgatggagagtgtttttccccaggactttttattctttaaagaaggcacaattatagctgcagtaaccccccctctttttttttgagacagggtctcgccctgttgcccaggctggagtgcagtggtgcaatcacagttcactacagcgtcagtctcctgggctcaagtgacccttctgccttagcctcctgagtagctgggactacaggcatgtgccaccacgcttggctaatttttttattattatttatttttggtaaagacagcgtctcactatgttgcccaggctggtctccaactcccgggctcaagtgatcctcctgccttggcctcccaaagtgctgggattaattacagttgtgagccactgtgcccggccatcagaagccccttgatatcctgctctggccccagctcattcccctttctgtctccccagaggcagccaatgtccagaaattgataagttatctttcacatccatgtttttgtattttttcaagcagcgtagtttggtgtgtttttttttcaatttttttattgcagtaaaatatacataacataaaatttaccatcttaaccattttagtatattaagtacattaatttaattactcacctaattaagtaattaaataatttggtatatgaagtccatttagcatattaagtacagcgatattaagtatattcatattgctgtgcaaccattaccaccatccacctccggaagtcctttcatcttgcaaaactgaaactcagtactcattaaggaatgacacttccattcccccagctcctgacaaccaccattctactttctgtttttatgaattttgctattctagagacttcatgtaagtggaatcatatagtatttgtctttttgtgtttggtttatttcacttagcttaatgtcctcaagatttatccatattgtagcatgtgtcagaatttctttcctttttaaggctggataatattccatttttgtgtgtgtatgtagatacacacacaccacacacacacatacatatgcacacatacatacggtaccacattttgtttatccactctttcatcaatggacactcgggtttcttctaccttttggctattgtgaataatgctgctgtgaacatgggtgtacaaatacctctttgggacacggctttgaattctgggtatatatccagaagtctaattgctagatcatatgtaattttatgcagaactgccatattgttttctacagtggctgtatcattttacattcctaccaacagtgtacaaaagctctgatttctctgtatccttaccaacacttgttttctctctctctctcttttttctttttttgagacggagtcttgctctgttggccaggctggagtgcaatgacatgatcttggctcactgcaacctctgcctcccaggttcgaagtttcaagtgattctcctgcctcagcttcccgagtagctgggattacaggcacacaccaccatgcctggctaaattttgtatttttagtagagacggggtttcaccatattggccaggctggtcttgaacccctgacctcaggtgaagtgctgggattacaagtgtgagccaccgcacctggcctctctcccctttattaatagtagctatcctaatgggtgtgaggtggtatctcttgttttcaatttgcacttccctaatgattagtgatgttgagcatcttttcataggcttattggccatttgtatatcttctttggacaaatgtctactcaagtcctttgtctgtttttgatttgggttgtgtgtttttgttgcttactgagtagtgtgtttttaaacattactcttaaagtatcacattgtgcatattttttctgcattttctttttcacttaatattctttttaaatttttttcaagacaatgtctcgctctgtcatccaggctggagtgcagtggtgcgatcttggctcactgcaaccttcgcttcctgggttcaagcgattctcctgcctcagcctcccaagtagctgggattataggtgcccgccaccatgccaggctaatatttgtatttttagtagagttgaggtttccccatgctggccaggctggtcttgagctcctgacctcaagggatctgcccgcctcggcctcccaaagtgctgggattacaggtgtgagccaccgcacccagatccacttaatattctttacttaatttattttaactgctgtataatactctactgtgttgcatacttctcttctccaatcttctattattggacatttaggtggtttccaattgttcagtatgacactgcttcagtgaacatcactacttgtttgtgtatatttattttttatacagtcataatattgtttttcagttggttctcttgtgttctctagaaagacaatattatcacaaactgaaaataatacttttgttgctttctttcctgtagttatgattcacatctatttctggtctggtacattgcttagaaatttcagaacagtagtaaacagcagtgggaacagtgactatccttgttttgttcttgacattaatgaagttgcctcctgaatttcactgttaaggatgactttggcatttggtttgaaatgttaatttttatttatcatcttgaggtattatttttcatttgaatttattaaatgaattttatagactaatttaaatattattatagtttttttcttctacaaattgttatagtaatagacttctaatattgaaacaaccttggagttttttgatgtattattctcccagtctattgcaggattatgtttgcttgtatctttttagtatttttgtatgtataacatattaagagtgattggcctgtttttgttgttgttgactatcttttaagtcacagttacaaggttttgtctttcctaataggacattattgagatatcatttacataaactacacacaccttaagtgtacagcttgatgaattctgacaaatatgtatacctcagtcaccatcatctagatcaagatatagcacattttcatggtcccagaacatttcctcatggcccctccagtcaatcttcgatccacaccccagcaaccacttccctgatttctatcaccagagattagttgggtctgtcctgtccttgaacttgtcctatatatgatcatatagtttgtattcctcagtatctggtttctttcattcaacataaagtttttattaaaaaattaaaaaaagttttttaaatttgttttttggagatggagtcttgctatgttgcccaacctggagtgcagtggctattcacagacgtgatcataactcactgcagcctcaaacttctgggcttaagtgatcctccagcctcagcctcctgagtagttgggactacacggtgcctggctgcataatgtttttgagattcattgaaaatattatatcaattgttttgctagctttgtaaaatgaactgataagatttacatctttttggccaggcatggtggctcatgcctgtaatcccagcattttgggagtctgaggcaggaggattgtttgagcccagaagatggaggctgtagtgagctatgatggtgccattgcactccagcctgggtgacagggtgagaccctgtttcaaaaaaaaaaaaaaaaaaagatttacatctttttcttttcatgccctgaaagagctaatgttacaaaatttatttgttttgtgaaaggtgaggtaactcacctgtgaaatcatctgaggctataaccattttaggaggcaatactttaagaactttctttaaacttttcctttattattgttctattcagatagtctagtttttgttgaagcaatttttaaagcaattttttaatgttatgttttcccagaaaataatccatttcattgcagttttgaaattataagcatataattgtaggtagagtcctcttagagttttaaaacctatagtttcccttttggcatttataacatttattcgtgttttttcctttttctttttttttttttttttgagacaaagtctcgctctgtcacccaggctggagtgcaatggcgcaatctcagcttactgcaatctctaccttctgggttcaagagattctctgcctcagcctcccaagtaggtgggactagaagtgcaccaccatgcctggctaagtgttgtattttttgtagagatagagtttcgccatgttggccaggctggtctggaattcctggcctcaagtgatccacccgcctcgtcctcccaaagtgctgggattacagatgtgagccaccatgactggcctgtttgtgtttcttctaaaggtagaagcaaagctgtttcatgaaccaactctaaaatttatttattaatcctactgtctttctgactgttaaggttactaatcaataatatttgcttttaactgttttactgctttcttcccctggttattttgatgttttattaaaaccaaattacttaaatgaaagtttattttacctatttttattcttttctgattagccataaaggccatttaaggctacaaatttgcctatgaatcagctttgtctcatcccatgagatttcttatatgttttctcttttccattgtttttaactagtctgtttgccgctttgatttttgctctttagctcaaatgttatccaggagagcacttaaaaatatctaagtgattgggttgtttaatttgtgtgataggaaagaagtgtttattatttagaattctccatggcttcctagggagggtggttcccatctctttagcatcgtttgtgttatacacagcagtgacagatgtaggtgtagaagctttaggggagctcagtctgagtccaattactcagcataaaaaagggtgcaagatggatgccttttcagagctatcagggagatgtgagaggggaagggtgcagatgacttgtgactaagacacgggaaactcacagaatttcccgtgtaattctgtgacccaaaagtaaatgggtccagttggaagttggaatgtgggtaggaagggagctggctgagagttaattttggaatagcatattggaatgagcaagatttaactgctttacttgtatagactctaacctgtagacagtgaggaatcatttgggatttcttgcatgcaagtgacgtgattgagatttattctcaatgttaagatcccattcacctcccagaatgctggtagccaggcagaagatggaaagattcttttttggagcatatgacaagcccaggagtagagccctaaagacactgacattggagtcttctcaacaaaatgtcctgttcagatctccttgtatgactctttgttgaaaagctcagaggtcccaatcaatttttagtgtctcagtgtttaatatgagcagaaaaccaaaggtcacttgacatttaagtaaagcctctaccatgaaggacagagacaaacaaataagcaaagaaaagaagcaacctagaggagttagacgatgcagggagaagaaatcttaaaagcgttaacattctcagagatacaacacaagatagaaagatatggcattcatgaaacaagtaaggaatgctgatgaaaagaacacacagaattcagagaacaataaaacaccagaaactcaaagaaattaaaagcaaaaaatgctcaaacgtgaacaatttaccagaaggattgaatgataaagttgagtcaatatttcaaaaagaaagtgatatctacaaaaaaatggaaaacagaagagaaaaagataagaaaaactagagaaacagactagggcgtccaacatccaaaaaacaggaatttaagagtgaaagggtacagaaaatgaaagggcaaacatcatcaaagaaataatttaaggaaaatttctagaactgaaggatgtggaattctagattgattgagacccatcataatgctcaataaaacagacctgcacctttgaaaagagaggtttttttttaaagaattatgcatctgaaatttctgttttacttagaagataattagtgctaaaattgaagaatacaagttaactttattttttatttattaatttttttttgagacttgctctcgtcactcaggctggagtgcaatggcatgatctcggctcactgaaacctccgcctcctgggctcaagcgattctcctgcctcaacctcccgagtagctgggattacaggcgcctgccaccacgctcagctaatttttgtatttttagtagagatggggtttcaccatgctggccaggctggtctcgaactcctgaccttgtgatctgcccaccttggcctccgaaagggtgggattacaggtgtgagccaccgtacctggcccaagttaactttaatggcaaagttggagaatacaagataacttgtgatttgcatgtggccagactgcatataaaaggacctctggcagcatctgtaacaaagtggactggtgtgatgtcaaagaaatagacattcctataatgaaagaatgtcatgtagaaatgtagcatcctaatttttaaagtattttagatttggttgggagaagaatctgtcacttacaaaataaggaggaggaaaaaataaacaatttagctttttttttttttttagagctatacggtttacaaagtgctgtggcctatatgtgataaactatttaaatttatctttttttctcagaacaatacgaacatatcaattaatcttaacaatattgcaagtgaggcattatgactcccatattgcagacaagaatgaggctcagagaggttaagcaaattgtccaagttcatagaatttgcaggtggcagaggtgggatttacatggcggtctctgattctcttggcctgttccttatcatcaccacgaggtcacaagatggttgaagaaggaagaaggagaaagggtggcaaacaaagggcaaaaaagaatgtgtaccagccctgccttttgtgacatctctctgaagtccacccagcagcctcttcttaagtatcatttgccagactatgctatgtggccacctctcttggcagaggaagctgggaaatgcggcgttttaattggactgcttccttgggtgaaaccaaagctctgttaggaagaaagatttgagttggcagccaggagtctctgtgaaagccaggaacaaaagcagctaaggtatccctttctttggctagctagaagctgtttacatggatagcctttttttcctccccccttggctttggataatgtggattattttcatgcagtagaaccaaattttcaatatagtgcatgtatttaatatttcaatatggcgagttcactggctttttctgtcttcagacaagatttttatgatggtcccaaatcctgttaagatttgatctgagttgttttgctaaatagcactcagtgttttaagctccctgaaagtggttacccatagttttctaggcttttctttctgtgccctcttccccaggaccatttcccctctgtcctctttcccaggaccatttcccctctgtcctcttccccacttcccattctccttctccaccagttcaattgctgtcaactcttactgaaatctcagctcatgcaattccagagagaatctctagttcaacgagttggggttgcagacagggaaactgaggcccagaaagtcagggtgatctctggcaaggactaatgtcctctggctctcctcagtcttcttgaaggaaggtcagtgattcttactcccaggaggaaagacagagagcgaaggccctgaagtaggaaagagactaggggcattaaaggaaacaaaagggggctggcatggctgcagcacaggtagtgaggaggagattggcttgagccaaagctagaagggtcctcaggaccatgggaagccaaggcatgcaggtgatgctgaggatatggggtgtatcggcttctgaagggtatcagctgggaaatagtgtaatttagcttaaaatcttaaagggtccttatgcctgcttcatagagacatattggggagggcaagaacacaaaagaggagaagagtgagggctactacagttgtcctggtgagagataatggaggcttgaactaacgtagaggcagttgggttggagggatgagtggatggacgtagagtatgttgtcaggctttgatgacagatttggggatgggagtttgggagaggggaaagggaaagaatcctagggttctgtcttgtgcaagtaagtagatgaaagagcgcttcatggaattagggagcactgggggaggaaaatattggagtggaagatccaaaattcacttttgtgctgaaatttctgtgatacattcttatggagatgtcagtaaggtagctagatgtatatcatgaaccagatttttctgttttatttctaattggctattgttatatatagaaaaactgttgcttcacgcaaatagatacttttttttctgagatgatctcactctgttgctgaggccggagtgcagtggtgggaacatggctcactgcagcctcaacctcctgggcttaagtgatccttaaacctcagcctctctattagcctggactataggcatgcaccaccatatctggttgatttaaaaaaattattatttttttttctgtagagacgggtctcggtatgttgcccaagctggtctcaaactcctgcattcaagcaatcctcctaattcagccttccgaagtgttgggattataggcatgaaccattgagtccagctgcaaatatactttgtattagaccattttactggcctctcttgttagtttgaatagcttttctgtgatttttttggtgttctcatatgtaattatattgcctgctaataatgataaatgtatttcttcctttccaaccattttaccccttattatttttcttgttttatcacattggctatagtagaggtccttttgaagttagcttttttaatgtatataattttttcttaaaaaatatggaatgcttcatgaatttgcatgtcatcattgtgtaggggccgtgctaatcttctctgtattgttctaattttagtatatgtgctgccaaagcaagcactacagttagttttaatggtaaacataatattgatatttgaccagctaagaggaagatgattttgagacaaagcttcgaggcagtgtatacagctcaaattatgacagaagcttagatgtggtgtgataatacatttgaataaggtggtgtcttagttcttgctgctgtaacacaatgccacagactgggtaatttatattgagcagaagtttattggctcatgattctggaggccaggaaatccaagatcaaggggccggcatctgacaagggccttcttgctatgtcatcttatggtgggagggcaaagagagggcgagagagggagcaaatggtcaaactcacagcctcaaacccttaaattcattcatggaggtgaagccttcatgactaaacacctcccatgaggccccgcctcctaacaggccccacctcctgacactgttgcattgaggattctgtttccaacacatgctttttgggagacacagtcaaaccatagcaggtgataactgaagacataaaaagggatataaataccaactctcttaccctcatactcatagccagaagaatggtctgtccataaaacatgatcacaatgcttcaaacctgaagcatggtggtcaaattgacaggaaactaagaatatctaaaagtaaaggttaaagttgggtagagtgtgttcatttggaaaagagaacagagaagaaattgatcataattctcagtttatgaacacctgtaaaaaggtaggatgaaaagaaatagacagataggtatattttaaaatcagtgtccatggttgaagcttaatcttccaaaatatcctgtaacaactataatttatgtaatgctagtatgcatataacatatcacttggtttccccatcacctcagtgatataggtagtaattcacatttatccatagtttgacattttctaacatgcttagattacctcatttgatgtttacattctcagggcttgctcccttgcaattaaggctacaataaaaatccatctgcttttagttctttgaacgcaatgtcctgcattctctctactcggcctttgtccatgtggcccaccttgtgatgcctgtttctccttcacaacccagttcagccccaaggaaaggcctctgttccattgtcagaagggagaggtgagtgtagccagccaggccttgaaggaattcaagccaggtagcaggtatagcacaactcaaatatgctgccgtaagctttgctgagctcccttgctttagggaagaaaagaaaaagaaagtcctctttagccagctgcatttcttcttcccatttccagagtgtaccagggagggtacacatgtgattgtccatgggctcacctttacccatcactcctctggggcagatgccaaatcatgtgtctcgtgatgcaagagcttcatgggggtggagcagggttgggtgctgtctaagagggaatgaatggcccaaagctccaggtctggacagtctgagaccctcttgctggggagtagcgttttgggaaaaatgaaatacacttggctggatctgaaactttctgtagttaggtctggttgggtggaaggggatcttgggtggccttcaagccttggagacccccaatccaagatctctaaggacgtatacctagaaccttccagcttatctgcatcgtcagtgtttctcactcttctgtgcatgccccaagttgtctctgctgtcaggctgcaagattgttgtggaaacaggctgagcctattccatcttgctcagtcacagggccttgtctggtgcctggcacacagagggctgcagcaagtgttggttgatttgaaatcacagttgagcctcctgcctcagcatctcagtcagtgctccatagccagtcacgtggctgcctacaaaggagaagaagataaaagaatcccaggtgactttgtgggttaaaggggttttaaagctcttgctttagaagctcaagtaaaactttcatcctgtgttgactggataaagcattctgtcagccatccggggctcgtctaggactgggggcaggggagaagggagagcaatgttgtcactttaattgcattggcataaatatttgatattcaataaattagatctggagcaaggaaaacattcttgcaaatggattttttacctggagcccagccccattagcagaggagtagagggcagcctgccccagggccggtaattaactcaagtggagcagaactaagcatttttgacagccttcctagtctggaattaactgtcatcttggagggagaaagaaagtacactgtcacattacgggcttatgagaggttctccagtgctgccagccccctgagtttacttatgtctccccttcatgccctgcaatgttattttcatcattagagacaagtttaaaagcaactaacgatgtattttatatccacgtaccagaatcacagatttcaccaaaagagaagacattagcatggtaattcaatttttttttctttttggcagttgtaatgaaacaagatacagtggatgctgttagaagtcacaacactgatatctggagatagtacaagctggattttttttctcctctctgtatcagcacttgcctgtaatgagcatagcttagccactgtctgtgctatctccccccgcccccacccagcgtttatgaaagtagcaattgcttctgagaaaaggcaaaaccgttggagcctgaagctccttctagaagccactgcttgtcttgttccgtggaaactgatactgtggaaattggagttgtgccgggtctggtcctggcaatgtgtgcgcaggcaattttttataaggttgcagatctcagccagactctcagctaggctgggtgtgaggatggcgtctccagcgatgctcagctggcttcagagggaagggctgcctgtgcatttgtatgtgttgagaggggtgagctgtgcagcctggtacacagatcatgaacatctgcttctcttagatcttctgcctactaccacagcagtaaaaccacgactcaccgccttcatcactcagcctcaacactgcttccctcatgccctacagacaatgggagctggaatcgcccttgatttcccctttctgtcatcttaagcacagtggcctgaggctgaccctcctcttagaacttgaccctcttcctctgtccggcaccactccctgcacagtggtaagtctgaagatgtgatcatgttccttctctgcttgaaagtctcctcagctttggctttcttcttgatgccccagcaggggccccaaaacttggctgttcattagaatcttggagacccaggctggctggaccagagtccacagagttcgcgctcaggcagtgcggagggcaacccatggtttacaggatcaagccctaaaatcttagcctaacatctcagcctcaatggcctcctcccctttgggccccagaaggcacggggctcagccacaatcctcaaccatgcacactgcccctcaactcttcccctggtcaacttccacttatcctttaggactcagtgaaatgtcacctcctctgtgaagccttccctaatttctcaggcagaattatggtcattcattcattcgcccattctcattcagcaaacactcgcaggatgcctgcaggttccacgtcctgtgctgggtcctgaagatgacttagcagcaaaaggacagatgccaggagcttttctgctagtggggaatacagaggagacacgagcaaagcagacagaatcaggggaggcttcctagaggaagtgacacatcagggtgatctgaagggtgtgtatgagttagccacaggagtgagggtggggagaggggaaggccttgggtaggaagagagtgtgttagaggacaggaacggtgagaccaaagcataaacaggccaggttccagccatctccccgcagcatgtggtgtgtctccagtgggagagtgctcagtaggtttttgtttgtttgttttttattttattttatgtttctttagagacagggtctcgctctgttgtccagtctggagtgcagtggtgcagtcatagctcactgaagcgtccaattcctgggttcaagtgatcctcctgcctcaggggcccaagtggctgggaccacaggtgtgtacgactgcacccagctaatttaaaatttttttataaagacagggtctcactattttgcccaggctggtctcgagctctggcctcaagtgatcctctggccttggcctcccaaagtgctagaattacaggcatgagctgctgcacccagcctcagtaggtgctggtggagtgtaaagtcaagcgagagggccagctgtgggcagtggtggacattgaggtagaaagccaatgtcagggatgggacaggatattccatccattaagatataggcgatggggtgtccttgcactttaaagatatatacataagtttagggccctgtgaggctggtattattatttccatttcacacaggtagaatttgaggttccaaacagttaactgacatgcccatggtcattcagctagtaaggggcaaagctgggacttgaacccaggcagggtggctctggagcctgtgcttttaacccagactgtcccatgcagctacagcctgacctggcttctcaccagagctggtcgttcctctttcacccgctcaaccagcccatgcctggctcagggctgtttcccggcatctgtgggacatttgaattttcaacgatgacgttcaagagggaaacagaatttttgtaaagagagttcagaaccctttgagagaatgacatgagacctgtggtagctgttgcattaccttcaggtgttggggaaatgcaagagtagtcagctgccctcctgagagccaggcctggggagagcacagttcggcaccccccttgttgctgctgggctcccaaatgcttggggagcattttctgtgctctgtccatgtcagcaccatattttattaagacattattggctgggcgcggtggccggccaacatggcgcaaccccatctctactaaaaatacaaaattagccaggcatggtggtgcacacttgtaatcccagctactcgggaggctgaggcaggagaattgcttgaacccagaaggcggaggttgcagtgagccaagattgtgccactgcactccagcctgggggacagagtgagactctgtctcaaaaaataaaataaaataagataaaataaaataaaataaaataaaataaaatatatatacccatttaccaccccccagatctagatatagaacatttttagatttccagaaagttcccttgtgcccccttccagtcaatctctgcttcccaccgctaggtaaccactgatttctatcactataagttatcagctttctatcattatatgttaaatttgttgtgcctgtgcttgaacttcgtatgataatcataggcatatactcctattttgcctggctttatttgcacaatataacgtttttgagatgcatccagtgttgttgctggtggcagtagactgttttttctcattgttgtctatagtattttgttgtaggaatacatgcaatttctccattcttctgttgatggacatttgtgtggtttccagtgtgaggctattaggtataaactgccacgaacattcccatgtagttgtgtctgtggacaggccgtgcttcagttttgacagtccaggtgatagtggaactttcatctcttcagctttcactcctaaagactttctaaaaataccctcatttgctctctctctacagatgggtgagggaagaataaaagcctctaaggaacagaggaaaaagttcttgctgggagatggacattagtgcatcagcaaatctcatccactctagctccacaagctttcttttttttttttttttgagatagagtctcgctctgtcacccaggctggagtgcagtggcacgatctcggctcactgcaacctccgcctcccaggttcaaggaattcccctgcctcaccctcctgagtagctgggactacaggcacctgccaccacgcccggctaattttttatttttagtagagacgggggtttcaccatcttggccaggctggtcttgaactcctgaccttgtgatccacccgcctcggcctcccaaagtgctgggattacaggcgtgagccaccgcgcctggccaacaagctttcttaaatgtgtccgcttgtctctgttttcccagctcccactggggatagggccatgtccatttcttccctcctctctgatctggtctactcaattctacacttgctacccccccagtttattctaaacatgagagccagggaagtcttttcaataccaaccaacccccaaccttccatgtaccattaaggccccccaaagcttccttctaccttaggagaaactttaaattccccatcctgcactctaggcctgacagcacatagttctgcctacctgccctgcctcctatcccttcccacaagctccgagtctttgcactggctgttccctctgcctggaatgtgcttcccaagggaatctgcatgacacaccctgtcaggactcttccaatggtacctctgtagagaggccttccctgatcacccagtcagacatagcagccctttcctctaacccactaatctgctttctgtctctacaaatgttcctattctggacattttatatgaatggaattatacaatatgtgactttttgtgtttgccttctttcatgaatcataaagttttcaaaatccattcatgttgtagaagaactcagtactcaactcctttttatgactgaataatattccattgtatggatataccataatttattcattcatcaatgggtaggcactgggttgttttcatttctttgattattatgaatatgcttctatgaatatttgtggacatgtttttatttcaacatgttttcactgcccatggctgtttaattagttcaattgctcagtccctctatgtttagttttttcaggaactgtcaaacttctttcccaaaacagctgcatgattttacattcccgccaacaacgcacaagtcttccaatttatccacatccttgctgacatttgttattctctgtctcttggattatagccatcctagtggatgctaagtagtatctcattggggttttggtgtacatttctctcataacgaatgatattgagcattttctcatgtgtttcttggccacttgtatatctttggatgtctaagcctttcactcattataaaattggattatgtgtcttattattgttgagttttaaacatatttgatatattccaaatactcttcccttataagatacatgatttgcaaatactttctctcattctgtgagttgtcttttcactttcttgatagtattctttggagcacaaaagtcctaattattattattattattttttgagacagtctcagtgtgtcgcccaggctggagtgcaggggcgtgatctcggctcactgcaacccctgcctcctgggttcaagtgatccttccgcctcagcctctgaattagctaggattacaggtgcatgtgccaccatgcctggctaatttttgtaatttttggtagagatgggtttctgccatgttggtcaggttggtcttgaactcttgacctcaggtgatccttccaccttggcctcccaaagcactgggattacaggtgtgagccactgtgcctggccaaaagtcctaaattttgatgaagtctaatttatctatttttttcttttgttgctagtgcttttggtgtcatatctaagagattcttgtctaatcctaggtcacaaagatttctacctaactttcttctaagaattttataattttagctcttgcatttagatcttgcatccactgtgagttaatttttatatatagagtgaggtaggggttcgattaattctttttgtaaagaaatttttttggctaattatcctagcaccatttgttaaaaagacaattttaccccctctgaaattgttttgacacttttgtcaaaaattaattgatcataaatgtaagggtttatttctgatctctcaattctattcttttggtctatatgtctatctttatgaaagtctcacactgttttgattactgtagctttgtaatatgttttaaaattgggacgtttcagtcttcgtactgtgttcttctttttcaaggttactctgcttattaaaggtctcttgtatttatatgttaatcttaggatcagtttgacactttttgcagaaaagtctgctcggattagattgagattgctttgaatctgtagagcaatcaaagaattttgccatcttagcaaattaaatcttgcaatccataaacgtggacgttttcccatttgtttaggtgttctttaaatcttttcaaggatgttttgtaatttcagtgtaaaagcctaagtattttattttgttgctatttgaaatgaaattgttttttaggtttcattttctggttgtgcatttctagtatatagaaacaaaattgatttttctatgttgattttgtatcctgcaaccttgatgaacttgttcaattattttgtggattccttaggattttgtacatacaagatcctgtctcctgtgaatacaggcaattttacttctactttggaaaaatggatgccttttattactttttcttgtctgattgtcatggctagaccttccagcacaatgttggacagaagttatgagtggagacatccttgtctttttcctgatcttaggcataaaatttgcagtcttacaccattaactatgatgttagctgtggatttgtttgtttgtagatggcctttaccagattgaggatgtttccttctttctattttttttttgagttttttttttaaatcataaaaggtagttggattttctcagttgctttttctgggtcctttgagatgatcgtgtgttttttgtcctttattctattaatatggtgtattatgttgattaatattcatatgttgaaccaatcttgtattcctgggatacatttcactaggtcatggtgtataattcttcttataagttgctagatttggtttgctagtattttgttgaggatttttatgcttattcataagggatattgatctatagttttctttattgtctgatgtctttgtctagttttagtatcagggtaatattgatctcaaagaatgagttagaaggtgccccttcctattctttattttggaagagtttgtggaaagtcggtattaattttactttaaatgttgggtagaactccccagttaagccatttggtcctgggctttggtttgtgggaagtgatttgattattaatttaattgctttatttgttatagtttcattgagattttctatttctttttgaattggttttggtagtttttttcttcctagaaatttctcaatttttctctaggttatctagtttgttggtatacaattgttcataatattccattgtaaaccttttttttttttttttttttttttttgagccacggtcttgctccattgcccaggctggagtgcagtggtgcaaacatggcttactgcagctttgacttcccagcctcaagcaatcctcccacctcagtctccatagtagctgggattacatgggtgggccaccacaccgggcaaatttttgtattttttttttgtagagatgggatttctccatgttgtccaggctggtcttgaactcctggactcaaccaatcctccctccttggcctcccaaagtgctgggatttcaggtgtgagtcactgtgcccagcttataaacctttctatttctgtaagattggcagtaatgttacctctttcctgatttagtaatttgagtcttctctctttattttctcttgtcagtataggtaaagatttgccagttttgttgatctttacaaagaaccaacttttgcttttattgagttttctctattattttttattttctgtttcatttatttctgctctagtctttattatttctttctttttcttgtttgggttaagtttgctcttatttttctggtttcttaaggtggaggtttaggatattgatttgaaatctttcttagtttgttaatattgacatttccagctgtaaatttctaagcactgctttagctgcatcccatgtatggtatgttgtgttttcattttcattcatctcaaaggattttctaatatacttgtaatttcttccttttggttttttattgatacatagtacttatatgcatttatggagtacatgtgatattttgttgcatgcataggatctgtaatgatcaagtcagagtatttagaatatctatcactttgagcattggtcactcaggagtgtgttaatatccacgtttgtgaatttttcaaattttcttctggtagtgatttctaattttatttcattgtggttggagaatatactttatataatttctatcattttacatttattaaaccttgttttatggcctaatatatggtctatccttgagaatgttttatgtgcacctaacaagaacaaattctctgctgttgttaggtggaatgtttcatagatgttaggtctagttgtttataggattgttcaaatctactattttctggttgatcttctgtctagttattccatccattatcataatgggttattgaagtgtctaactattgaccttttgtctatttcctccttcaattttgttgggttttgtttcatgtattttggagctctgttgttaggttcatgtatgtttatacaggttgatctccttaatcagaaaatctgacatctgaagcatctcaaaatccaaatctttctgagtgccaacatgactccacaagggacaaattctagtcctgacctcacgtgctttgtgatggttcaacgtacctgtatacaaactttgtttcatgcataaaattatttaaaacattgtataaaattaccttcagactatgtgtacaaagtgcatatgaaacataaatgaatttcttgtttagacttgtgtctcatccccaaaatatctcattatgtatgtgcaaatattccaaaatctgaaatacttctggtcccaagcattttggataaaggatacagcctataattattgtgtagattgatccttttattattataaaatttcctttttcatttctagtaaaatatctttgtcttaccatctgttttatctgatcttagtatagctactacagctttcttttagttactgttttcatggcacatttgtttccatctttttactttcaactcattggtgtttttgaatctaaagtgtgtctctataaatagcacatagatgaaaaatgttttaaaatccattctgtcagtatctgccctttgattggagtgtttaattcatttatatttactgtaattactaataaagtagaatttacatttgtcatttactatttgttttctatatatgttggatcttttgtattcctctatgcatccatattgtcttcttttgtattagctaggtattttcttgtgtaccattaaaaaaccctttttttcccctttactatgtgttttttgaagtaaatttcttagtgattaccctgggaattgtaattaacaacttataacaatgaagttcagattaatcccttctcaatttcaatagcatacaaaaactttaaaaaaataactctattacctccctcctaccttgtgctgtttttgtcatactgattacatctttatatgctgtatgcctatcaatacagtttttttattaagagatagaattggccaggcatggtggctcatgcctgtaatctcagcactctgggaggccgacgcaggtggatcacctgagatcaggagttcaagacccacctggccaacctggcgaaaccttgtctctactaaaaatacaaaaaattagcctggcatggtggtgtgcacctgtaatcccagctactcgggaggctgaggcaggagagtcgcttgaacctgggagatggaggttgcagtgagccaaaatcacacgatctcactccagcccgggtgacagagtgagactccatctcaaaaaaaaaaaaaaaaaaaagatagagtctcattctgtcactgaggctggagtgcagtggcaagatcatagctcactgcagctttgaactcctagactcaagtgatactcctgcctcagcctcctgaatagctaggactacaaatgtgtgccaccgtgcgtggttaattaaaaaattttttggtagaggcagggtctcactatgttgcccgggctggtctcaaactcctgacatcaagcaatgcccatgcctcagcctcccaaagtgctgggatcacaggtatgagccatcacacctgccctcaatacagttttgtaattattgctttatgaaattgtcttttaaaacaaatagaagaaaaagttacaaacaaaaaatgcctatacactgccttttaatttacctgtgtagttcacctttactgatattctttacttcttcatatttattcaaattgttgtgtagtgttcttttatattagcctgaaggactccctttagtatttcttacgtgacaggcctgttagcaacaaattctgtctctttttttttaaatataggaagttcttatttttccttcagtttcgaatgatagttttgctggatatagaatttttagttgacagtcattgtctttcagtgttctgaatatgtcattccattgactttggcatccatactttctgacaagaagtcatctaaattaatcttattgaggatcctttgtatgtgatgaatcacttttctctggatgctctcaaggttctctctttgtctttgggttttcaccatttaattatggtgtgtctaggcatggctatttgagtttatcctacttggagttcactgagcttcttggatgtgtagatgaattttttttgtaacattttggaagtttttgcccattatttcttcaaatattcttatcgccttctcttctctacttctgagactcccatggtgtgtgtgttggtacacttaatggtgtcttacacgtccctaaggctctgttcatttttcttaattcttttgaaaaatttttctcagactggaaaacctcaatggattaatcttaaaggctgccttattttttatctttcctgctcaaatctgctgttaaaattctctagtgaagttgtcattccacttcttatacttttcaattccagaatttccattttatcgatattttctatttggtgagacattattcttatactttcctttagttctttagacatgatttcttttgttttttgaatatatttaaaagagctaatttaaaggctttgtctattaagtgcaatgtctgtgcttcctcaggcacagtttctgttgaccacttctttcctgtatatgggccatactttcttgtttctatgcatgtcttgaaagtttgttgttgttgttgttgttgtttgaaaacaggacattctaaataacatgtgacaactctggaaatcagattcttgcttcttcctagggtttgttgtttttgctgttggttattgttgtcattatttgtttatttggtgactttcctggactaattcttaaagtctgtattttttattgtgtgtgaccactgaagcctctgctcaggttagcttagtgatcagttatcgatcaggcagaaatttccttaaatgtccagaaccagtaagtctcccagtctttgttaaggggctctgtttgcatgctggggcacactttcaatactcggccaagcaatttgtaactctggtttagtcttcactgtctgcttgcagagaggctgaaggtcagccagaggtgagtgcttaggcccttctcatgtctttcttgatcatgtacacagccctacacatatgtatggccttcttttcaaaacccactatggaatttctttctctaggttttccttttaagctttttggttagcttgttgttttcccaaactgttatcttcccttcaggcatgtacaatgttaaataattctgcatattgtttttgacaaaagcccccaaagggggaaaaaagaatgttcacaatggatgaactctgagtcaggtcaaataaagacatggcttgtgagtgggattttgcagggggcttccagacaggtcaaataatgacaattctctgagaatggaggtttaaaggagctccagcccccttctaacttctccaggggctggtaggctattggttattcctgtgattataggctgttaggtttcaaggttactgtgggctgaagagcaggaatgggttgaggtcaagttaaaatgtcacaaagctcaaggttcttatgaagattcattgttttccttcaataaatgctcctcagattgctgtaagctttgatttgtttctagagttctgaaatagttggttctgacaaattctgccagtgttctcattgcttttatggaagaaagaatttttggaagttctcactttgccattttttgataatgtcacttctttgtagacaagcattgtcttctttgtgacatctttttgttttgttttgtttttttttttggagacagagtcttgctctgtttcccaggctggagtgcagtgaggtaatctttgttcactgcaacctctgccttctgggttcaagtgactctcctgcctcagtctcctgagtagctgggatcacaggcacacaccaccatgcctggctaatttttgcatttttagtagagacaaggtctcactatgttggccaggctgatctcaaactcctgacctcaaactcctgatctgcccacctcagcctcccaaagtgttgggattacagacatgagccactagtgcccagtccatcccgtggtttttaatgccactgttaatattctccagccaaataccaccatgcatatcctatatttgaacaaagttgagtttattgaccttgcaacaagagagaccacacacccgggggaactgtgaggcacctcatgagaggtatcacgaaggatccattacaggatttgtgtcaagtgattttgaggaggtttcaaagaagcaaggcttttctctgaagtggaagctttctggaagtggaggaaattctgtgattggatattttaataaatcttgtttagaaagtgggaagaatgaagtgcgattaaagctgaaattggtaaggaagcagcagccaccctcattagctagcatattgggtatagtaggctgaataatggctgccaaagatatcaggtcctaatccctgaaacctgtgaatgctgccttagatggaaaagttgtctttgcagattaaattaagggtcttgagattggggagattatcagggtgggtcctaaatatgatcataagtgtctttataagagagagacagaagaaaactctctctctctctctctctcaggagaaggcaatatgaagatagagacaatggagattttaaaacgttgattggtggagactggaaagttgtggtcagaagccaaggaatgctgacagccaccataaactggaagaggtgaggaatggattctttccaagagcctctggggagggagtgcagacctgcagacacattaattttgacccagtgatactgatttcaaactctgactttcagagctgtgagaaaacatatttctgttgtttcaagccatgaagattgaggtaatttggtatagcagccttaggtaactaatacagagggtgtttgttcatttttgtggtttggacaatgtccttatatttgcattagttaatgggttatagatataatcatgttcctcaaattcatatgttgaagtcctattcccccagtacttcagaatgtgaccttatttggaaatggagttgttgctgatgtaattagttgagatggggtcagtagagtgggcccctaacccaatgactggtatccttataaaaatggtgaagtttggacatagaaacatacacatagggagcacaccatgtgaagattagagttatgcttctataagccaagaaagtacaagaatcttgagaggagcttgggacacattctttcctactactctcagatgaaacgtggacctgaagtcaccttgatctcagacttctagtctcctgagctgtgagataataatttatatttatttatttatttatttatttatttatttatttatttttgagacagagttttgctcttgttgcccaggctggagtgcaatggcgtgatcttggctcactgcaacctccaccccctgggtccaagcaattctcctgcctcagcctcccaagtagctgggataacaggtgtgcgccaccacacctggctaatttttgcatttttagtagagacggggtttcaccatgttggccaggctggtctcaaactcctgacctcaggtgatccacccacctcggcctcccaaagtgctgggattacaggtgtaacacgcttcagatatgagtacagagtggtctagcttttgtcttgctccagtgcagttacataatggccctgtctgatgttggtgttctgcaagattgtttatgtccaacaagaaaacaccagggcccaaccatgggtgccaggtaagcttcccaatgccaggggctgcttttctctttttcactacaaagtctttattcatcagataaatgttcattttaggttgtctttaagggttttaactaatttatttattgatgtatttatttttataacagggtcttgctctattgcacaggagtgcagtggtacaatcatggctgtctgcggcctcaatctccctggcttaagcaatcctcctgcctcagcctcccaaagtagctgggactacaggtgagtgtcaacgtgctccactaataatttttttatttttttatttttttttgagacggagtctcgctctgttgcccaggctagagtgcagtggcgcaatctcggctcactgcaagccccgcctcctgggttcacaccattctcctgcctcagactcccgagtagctgggactacaggtgcctgccaccatgctcggctaatttttttgtatttttagtagagatggggtttcaccctgttagccaggatggtctcgatctcctgacctcatgatctgcccgcctcggcctcccaaaatgctgggattacgggcgtgagccaccatgtctggccagtttgtatttatttatttatttttagtagagatgacgtctggctatgttgtccaggttggtcttgaactcctggtctcaagcgatcttcctgcctcagcctcccaaagtgctgggatgacaggtgtgagccaccatgcctggtccaattctttttctaaacattaaaatattcaatccagctgccgtttattttggagtgggggatggagtgagaagtatgtggcctcaggtagagggcatgaggttcaaagtgattataggggtgttggcgctgaacttgctgaggtcttcatggacctgggtggttgacctggcagcctgctatggtctcaatgtttatgttccccgcaaatttgtatgttaaaatcctcagccccaaggtattaaaaagtagggcctttggaaggtgatttgttcatggaggcagagtcctcatcaatggaattagtgctcttacaaaaaagccctgagagaaacctctcaccccttccaccgcgtgaagacacagcaagaaggtgtcatctataaagtagaaagtgggccctcggggaggagccaagatggccgaataggaacagctccggtctacagctcccagcgtgagcgacgcagaagacgggtgttttctgcatttccatctgaggtaccgggtttatctcactagggagtgccagacagtgggcgcaggccagtgggtgcacgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaatggcgcaccacgggactatatcccacacctggctcggagggtactacgcccacggagtctcgctgattgctagcacagcagtctgagatcaaactgcaaggcgacaacgaggctgggggaggggcgcccgccattgcccaggcttgcttaggtaaacgaagcagccgggaagctcgaactgggtggagcccaccacagctcaagggggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactcggaggcaccccccagcaggggcacactgacacctcacactgcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatatataactagaataaccaatactgagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctaggcagaaaccctacaagccagaagagagtgggggccaatattcaacattcttaaagaaaagaattttcaacccagaatttcatatccagccaaactaagcttcataagttaaggataaataaaatactttacagacaagcaaatgctgagagattttgtcaccaccaagcctgccctaaaagagctcctgaaggaagcactaaacatggaaaggaacaaccggtaccagccgctgcaaaatcatgccaaaatgtaaagaccatcgagactaggaagaaactgcatcaattaacgagcaaaatcaccagctaacatcataatgacaggatcaaattcacacataacaatattaactttaaatgtaaatggactaaatgctccaattaaaagacacagactggcaagttggataaagagtcaagacccatcagtgtgctgtattcaggaaacccatctcacatgcagagacacacataggctcaaaataaaaggatggaggaagatctaccaagcaaatggaaaactaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccaaacattaataatgggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaagagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactgaatgcccacagaagaaagcaggaaagatccaaaattgacaccctaacatcacaattaaaagaactagaaaagcaagagcaaacacattcaaaagctagcagaaggcaagaaataactaaaatcagagcagaactgaaggaaatagagatacaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaacactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcacactgaatgggcaaaaactggaagcattccctttgaaaactggcacaagacaaggatgccctctctcaccgctcctattcaacatagtgttggaagttctggccagggcaatcgggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagataaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctgagccaaaagaacaaagctggaggcatcacactacctgacttcaaactatactacaaggctacagtaaccaaaacagcatggtactggtaccacaacagagatatagatcaatggaacagaacagagcccccagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaaacaattcaagatggattaaagatgtaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaaaaaaaacaaccccatcaaaaagtgggcgaaggacatgaacagacacttctcaaaagaagacatttatgcagccaaaaaacacatgaaaaaatgctcatcatcactggtcatcagagaaatacaaatcaaaaccactatgagatatcatctcacaccagttagaatggccatcattaaaaagtcaggaaacaacaggtcctggagaggttgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatatcctttgtagggatatggatgaaattggaaatcatcattctcagtaaactatcgcaagaacaaaaaaccaaacaccgtatattctcactcataggtgggaattgaacaatgagatcacctggacacatgaaggggaataccacactctggggactgtggtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataaaaaaaaaaaaatgcaaataaatgtgaagatgaaaaaaaaaaaaaaaaaagaaagtgggccctcaccagacaccaaatctgctggtgccttcatcttggacttccagccttcagaacgatgagaaataaatttcaattataagccacccaatttatggtattttgctctaggagcccaaaaggatcaagacacaggtatgagtttggcttatgccaattgtttttaattcccctcaagctgacttgtacatagaaatgacctcagaacaaccactcagagcatctggggagtcattcctttcctcttccttgttgtttttgatggaaggaaaagtgtcaggcccattgaagttaccacgtgccatggctgtgagtgccttcactacttggagtaggctcatcagtagacaaccctcccagagctctacgtgcagccggcatctgcgcggtctgttagggtaagtgcagttcaggatcaattatggatgaggctccacagcagatgagtaagtgggctgttgtctactttgaaaaattaatgggatctgattaatacgggagaacagtccctctcttcctcaacccagagaggctcagatctctgtggaagcttgagggtttggcggttggggaggagggagctcctgtgtctgtgggtgtcaggtttgattcataggatcatgctttggaattttctgctcctttgacagatgaggctgctgaattccatcaaggtgaatcaatttgcccagacaggtagaaggaaagagaatagtcaattagtattattttaaaaacttaaaagcttttctcatatggaaaattaaaaacatttacagaagtagagagagatcgatatcatgtagccattctcaaactttttggtcttaggaatgttttataatttcaaaaaattattgaggacctcaaggggcttttgtttatttgaggtgcatctattgatattaaccgtattagacgttaaaactcagacacttaaacatatttattaactcatttaaaaaaacaataatcctattacatgttaacaccagtaacttttttgtttttgacactttatgtctactataagctttcagatgacaattatacgttctccattagatttgcttttatttcatttttattgtagtaaaatatatataacagaaagtttaccattttaaccttcttctttttttttttttttttttttgagacacagccttgctctgttgcccaagctggagtgggcaacaacccatccaccttggcctcccaaagtgctgggattacaggtatgcaccactgtgcctcaccccattttaaccatttttaaatgtacagttcaatggcattgagtacactcccattgtgcaaccatcactgttatccatttccggaaacttttcatcatctcacactgaaactctgtacccattagcaactctccatccgccttcccccagcctcttatgaatactgttctactttctgtctctatgattttcactactctgggtatttcatataagtggaatgatgtcatgtttgttcttttgtgaatgacttatttcacttatcataatgtcctcaagattcatccacatactgtagcccatgtctgaattgccttcctttttgaaactgaatattccttgtatgtgtacaccaccgagtgatcctccattgacaagaggctgtggctgtttccacctttcggctgttgtgaatgcaaacattggtgtacaaagatacgtttgagaccccgctttcagttcttttgtgtgtttacccagaagcggaattgctgaatcacacggtaattctgatgtttctgtttttgaggaatcgtcccactgttttccatcgtgactggagcattttacattctcaccaacagtgtgcatgtgtaccaatttcttcacatgcactccaacacacgttttctgtttttcttaatagcaatcccaataaatgttaaatacattcttaatttaaaaaccccaatatttcccaaacaaaaaaattagtgagaaaaagacattgtattacattttgtaaatcttgaatgcctggcttaatgggcagctggattctcatatctgctttttcatttaatctttgtgacatcacatgctgtgtggcctctagaaaactccacagtaccctcatgggagaaggaaagggagaaacgcaaatgacatgctagtattattaggaaaataggtttttttaaaaaatttttttgagatggagtctcactctgtcacccaggctggagtgcagtggcgcaatctcagctcactgtaacctccacctcccgggttcaagtgattctcatgcctcagcctcctaagtagctgggactacaggcatcgtgcctggctaatttttgtattttttgtagagacggggtttcaccatgttggccaggtttgtctcaaactcttgacctcaagtgatccacctgcctcggcctcccaaagttctgggattacaggtgtgagccaccacacccggccaggaaaatagttttgattttgtggacttcagctttaattatcaactcagggtcaatctcgtttcatctcttctccctcttgcctcccctcttcattagtttggagcaaacctataaccatcagttactatcagcattgcattaggcgcggtcctgtatccttttcctaactgtcataagaaatccactttattagcagctatgagtatctggttgttcacacgaggaaaccaggctttgggaacattgggagattttctcaggttcacactggagaagctgagggcacacaggctggagcccaggtcagatatttattataccgttttctttttgttcttgttgttgtttttctttgagacagagtcttgttctcatgcccaggctggagtacagtggcacaatcttggctcactgcaacctccacctccttggttcaagtgattctcctgctacagcctcctgaatagctgggattataggtgcctgccaccatgcctagctaatttttgtatttttagtagagatggggtttcactatgttggccaggctggtgtcgaactcctgacctcaagtgatccacctgccttggcctcccaaagtgctgagcttacaggtatgagccaccatgcccggtcaatattatactgttttctacacttgacataagaccatgagcactattgggttggccttctgtctgtgtctttttcccactgggactttaggaaaagctcttgttttcctccctgcctccatctctcacatgtgggtgctcttttggtaggtttttgagtagccctctagccaggcctcgcgcaggctcctggacagatagctgaactggatgctgctgtttgaagcaattctggatcatttgtttggactggatctggatcatgagtggagacacctctattcactgtcgaattaatggagtccacacaatgcaggatctgaggtcatccagtcctgactgcctcccaagactgaaaccctctctaaaacactctgcccaaaggtcatctgacctctgcttgtatacctccagtgacggggaactcactacctacctcagcagacagccagaccatagatggtgctcttattgttagaaagctccactcacattgcataacattgcaggaacaacctggattcacgctgtggtgggaaaaactcacactgggagttgagattcctgggtatgagattggggtcactgtggttaagtcccatccccttgaagggtttcagtttcttcgctgtgaagagcacttatctctggttcctttcaccactaacattctgatgtattttctaatttagccacctattctagaggagcagtattgaagggcttggggaaaccgagtgctctctaagtgtggccctcaccatccttcctggtgcgctatctccagccgtgcatccgaaaacatcccagtctgcccctggcctctgcatggagcctgacccccaacacagacctctcaagaggttctggattcactggtgctgctacagccctgagcaaaaacacagctgtttcgtttaccaccccaccccaacataagctgtcctcagactttacaaagacttagggattgcacagtccacaagactttcaatgcctttgccctgtatctcaactaactttcaaatagagggaccttcttataggaagaagaaggaaaaatcaagtggaaaaacaccttgatcaggtaattgaaggagaactggggctcaggctgccacttggtttggaaagggtgtggaggtggctaatctggccctggcctaagagcaattccaggctggcgggctggaccgcctgtctccatagcaactgttgttattggtaactgaataaccatttcctagaacagcggctggagctgctgatggttttcccttctacttggaagcgagaggagccaggctctttgctgattgatcctaagtgctgagctctttgctgattgggatcttcacttgatattgggcaagctgaagccacccttctgttttatctctgacctctgccagcagagagggtgggacaaactgacttaatgtctattttccggcttcctctgagaggttgagaaaggtgctcaagggcatttagctagcaagatctagaacttgaactttgccctgtctgattctgaaacccatgctcgtgaccacatggctgttctgactctgtcccattcctctgagatctcatgaaaacctgattagccctttctcatgacaccatgagctgtctaattatttgtgaggacaggtagcatcttacagtgatccatggtctgcacaaaggctgttctagaagctgtcttacttgattatcctgcagtggtgtcagtgggaccttaaaatgctgtagccctagagttattagggtcatgctcactgaggccattgcctcaaacttcctgctctccccctgcactctccctccatcctggggagtgataggtggtggagcagacctggctacaggagtgaattccagatcactttcatggaggcacttaggctattgtgtttgttaccaagccaaaggagcttgctgcccaatgcactagaagccaatactatgacactgggtttttgagaaacaaaaagctttttaagtcgactaacaaggagacaggagtccggctcaaatctgtctccctgtgctggctttcagtcatttcattaaaaaaggttgagggggtagattctgggattagcggatgattggtggaaggaaaggggaggtctggaaagtcctcgggcacgcgcagttctctctctatgctaccacatgtgcaaatttgcggggagtgttcatgtggaacaggcagtgtttcctgtttccagaccaggcaaggtggctcacaaatggctctacgatccagagaaagtcagcagggagggttgtgatttgttattatgaaaaattaacaaattacatccaaaatgtgtttaactcctattccctttgaaaaggatctttgggtacctaattgacatattttaagagacatattggctagttagacatcaattgacatcctcattaaatatcaattaacacatatcctaacgtaatatttaattagcttgctgtagctattcttttaaaagtcaattaaatgcttggcatattcttacaagccgactccattgatagcaattatggatgaattcctgtcataagtcatttttagtggatagcagggcaaactgattctgaatatacacatcaggtctttcaagaagaatttaaaaatcaatcattagatatctaatgaaccctcttctctgctgattgtgaataaaaggcatgttcggctcttggactgtagtttagtgcattttcacatgattgttggaactctaggtcaaacagaacagacacctgcctccagggagagtcgtgcttcatttgaaaagaaaattgtggtaaaataaacataacataaaatgtagcatcttaaccttttaaaaatgtatagttcagtagagttaagtacatttgcattgtacaaccagtctccagaaccgttttaatcttgcagttctgaaactcttgtacccattaaataatgattccctttcctctctcccctgagcccgggcaaccaccattctaatttccatctctaggagtttgactacttgaggtgcctcatatggaattatacaatatcttgtgtgtgtgtgactggcttatttaacttagcataatgtcctcaaggttcatccattttgtagcatgcattagaatttccctccttttaaaggctgagtaatactgcattgtatgtctagaccacattttgtttatccattcatctgttaatggacacttgcattgcttctaccttttggctatttggaataatgctgctgtgaacacgggtatacaggtatctcttggagaccctgctttccattctttgggtacatacccagaagtaggattgctggatcatagagtgtattagtctgttcccatgctgctagtaaagacatacctgagactggataatttataaaggaaagaggtttaacggactcacagttccacatggctgagtaggcctcataatcatggcagaaggcaaggaggagcaagtcacgtcttacacagcgggtgtcagacaaacagagagaacttgtgcaggggaactcctctttatataaccatcagatctcttgagacttattcactatcatgagaacagcacaggaaagacccacccccatgattcagttacctccctctgggtccctcccgtaacacgtgggaattgtgggagctataattcaagatgagatttggatggggacatagccaaaccatatcatagagtaattctattttgagttttttttgtggacatttttaagttaatttattcaatgcactcattaagcacctgtgctagtggacattcttaaaaaaggtgagctcagtctggtgagctggccggcccaggagtaagcctaacctgttagggctactgctgcagtagtgataatgtgagcccagatggtgtgatcagtgcatttctaacagtgtggcatggatcaggcatagcagggaggagagtcaacacagctggcctgaggctgcatcctcagaaaggtctacttgcaaggttggcccttggctggtgtctgggtacttgggttttgggaggattctgccattcccgtagctgataatagtggctcactgtgcctaaactgtttgtaggcatgtgctgagcccctactttccttctgggagtctggaatttcagtacatgttaggcagagtgtgcttatatgacctgtcccagtagaagccgtgagtattgactctctaatgagctttcctggtaggcaacacctcacacatgtcaacacctgtccctgggagaatgaagtgcatactgtgtgactccactgggagaggactctgtgaagatcgcacctggttttctctggactttgtcccatgtgccttttcccttggctgattgtttcatatctttttgctgtcatgaatcacagccattactatgactctgcattgagtcctgtgagtcctccagagaatcatggaagtgttcctggggacccctgacataggtgataccctgcaggaggccttatagaagcagaggggacatccgaggtagctcttgaaggacagggaagagttttccaggtggacaagggaggggtagccgtctagccaaaggcacatcatgagctcaggcatagagcctggaggagagtggcctgactaggcagctgcagctgaaacagaggacagccaaagccaaaagggtacgggatggccgctcatgacaggccaggagctgaagagctgggactctgtccatcaggcaatgaggagccccagtggagtttggagcaggagtgagggatgagggttctgctgaaagccccagtgggggattccaggtgtagtgagaagagaaggaaagcagacagaatgagaaagcagttgatagagtagccaagggggtggagaagagggaggaaaagggaaggaggctggagaaggaggaaagacagtcatcaggtacccatgggagaacaagtcatccctgcctatggtccacaatagggcaaccaccactgcccaagtcctcagaggatttcctccacatcctgcaggagagaggctgccctggctctgttggccaaggcagctggggtgagccatgtgtctctctctgcctcagtttgtctctctgttaaatgggaatgcaacaacacctacttgatggttgttgtgaggaattcctggaataacagatgtgattcaacttttatcccctaatgtgatgtcctcaggtggaggtgaagatggaggtaatttctaagtctggggcctgaaagctgggttcagagacaggccacatgccacgtcaggtcagacagtgaggtagctttgcagaaggaagccaagtgtattagtccattttcacgctgctgataaagacatacctgagactgggaagaaaaagaggtttaatggacttacagttccacatggttggggaggcctcacaatcatggtggaaggcaaggaggagaaagtcacatcttacatggatggtggcaggcaaagagagagcttgtgtagggaaactcctgtttttaaaaccatcagatctcatgagactcattcactatcacgagaacagtgcaggaaaagcccacccccataattcaatcacctcccaccaggttcctcctatgacacctgggaattgtgggagttacaattccagatgagatttgggtggggacacagccaaaccatatcaccaagcttctggagacatccattcctgatgtgggaaagtgatgccacgtattctggctgaattagtgaattcagtccctcctaggacactgtatcttggctacagagaggcatcttcaccctggaggtggggaccacatggtggcatgggacggggaggaatagcacactgcacagggtgctgggggcctgctctggtgcctgctccctctgtgtcctgggtggcgtgtgatgtggctaacgtgactgctctgtgtctggattctgcattgtgcctgtgcctggccttggaaccactttcaccctgaaaagtaactccaggactgttgcttctgcccattgccactcccctgcctacaagataaaggccatgcttcttagcttggcattcaaggcccccataatgacctccaaccctttttcctgatgtctgccctggctccgccccctggcacctcctcattatattctctgactgcactttttaccccattcctgacattacacccacctagtctagtctaccaccaaggcaatgacccccacgcctcagtagctaaagcttttccaaactgtgatcttgggcaagttccctctggtgcctcagtttcctcatatgtaggaaggacatgacacgagaggctgccctgttggcagctgggactacttcattgtttgtcttggggattaggcaagatggggttgaaccagtgactacctgaggcttctgtctactctgccccaagaccacctgctcccaagcccctctctggcaccatctgtcctcatttctgcccccaagcttctggcctttattctcagagatggccctgggtgttgcacaagcaaggtttggcctcaaacagacctggtttaaaactcacaggttgggtgcccctagacaagtcactcctctcctctgatccttaggtgggtaacagggggagctcatggagactgatgagttaacacttgcaaaatgcccaatgtccaggtgctctgtgaatgtcagtttcctccctccttccatgcccagtgcgggtctggcttcaattctgacgttaagtcagcccagcagcatgactgggaagagtggattctgcagtctgccgggagtcagctttgccattcactggctgtgtgaacttgggtgggccacttaaactctccaaactctgagtttctcatgtgtaagatgggggcaatcaagtgtccacccctaagcgttgttgtgaggagctggcaagagatcacagccccgtgcctgacacataagaaactcttaggtaaagctttgctgctactagtgatcttttctttcccaactctagtggattgtactttccaaaggaggctgcaacaatagctcccatcccatatgctcttcttacaaggtgaccttgatacaccccatcaggaggtgaagtctatgtccccaacccttgaagttgaacagacctttgcaactgctttgaccaacagagtatggcacaatgacgcgatgtgtcttccaaagggaggtcatgataggcaatatagccttgcctggctctccctctctaggcacacttgctctaggagcccagccaccatgctgtgaggaagcccaggtgaccaggagaggccatgtgtaggcgttttggatgacaaccagcctcagttatcagaaatgcatgagtgaacctttaaatgattccaagccccagctcctgtctgagcacaactgcaggagagagcggagaaccgcccagctgaacccaatcagtccccaaactgtgagagatagtgataatgatactaataaaaaaattctgtgggctgagcacagcggctcatccctgtagtcccagctatttgggaggctgaggtgggaggattgtctgagcccagaagtttgagaccagcctggccaacgtagtggaaccccatctctccaaaaaattaaaaaaattagctgggtgtgggggcacatgcctgtagtctcagctacttggaaggctgaggtgggaggattgcttgagcttgggaagttgaggctgcagtaaactatgatcgcatcattgcactccagcctgggtgacagcaagaccccatctcaaaaaaaaaaaaaaatcatttggtgaatatttttaagggaaaacagcaaagttttttcctattagtcggtgacctcagcatggcatcaatagaaaaacaagttgggaggaggggttgctggtggctattgataactgtcatggagggcttaggatgacagcagagttgtccctggggatcgtcgtgaacctcagcttcgaagctaagcacagacaacacagaggcggcagcagccggtggggatgtgtgtgggcctgcaagtcagacctgggtggatcctgcttccagcacccaccaactgtgtggctttgggcaagtcccttccctattctggacctcactggagacatgtttaatacacaggggctgggcttgaatgttcgtaaagatgctttggccacacacagggctgtgattctcagagagaaaaccccccttccgcgccctctcccactgccaggtggagatggttaggaggtcgggagcctctgcaggacacagggcaatccccatagagacaccagcttgctcagtccgtccgccatcttcatggtcttctctgccggccctctttaccttgcatttcccagcatcacctcaccgactcctctcattgccacatttctgtcctgtcacctcccctcacattttgctgtcacccacacccttgtagccatcctgacaggttcccactgtctccccaatgcattcatagactctcctacaactgccatcaaatcccaccctcttgcttcacaatccctcacaatccaaatgtcaattccttttacaatttcaggtcacatgccaacatccatcctcttcacccctgcaacccccagatgctctacaacctcaaggcaccacctccactctctactaccacccctgaagctgcccagcctttgcctatacttttgtggtcacctggaccatggtaaacgcttcccctgtcttctcattgtccccctcaccccacccaaaaccagcctgaaaattactgagttcccatttgctgcctggatctctgctccgtttcctcgtttgataatgaagagttgttagtataatctctgctttgcacgtggaggacttgaggttcagggaggctaactaatctgcttggagtttcacggggccgatgcctgaatagccgacacctggctaatgtcatgcctgcccctgctgcctcctgcttctcttacccgcattgtctgactttcatcctattctctctccctcctcctgcacaccccctccccacacctcctcccttccaagtgccctgtgtcgaactgaggcagaatgatctgagtacaaaggatggaaagatccagcaagcatggaatcctttggctcttggagcctcagatttcttaactataaaatgggagcaagagatggttccttcacgtgactgctatgagcataagcaagagcatacctgtggcgtcatgtaacagagttgggtgcacagaaagcatttaatgaatgaacaaaaatattccaggcacaggatgccatcaggtcatgaaaaacatcttttccagatccccccacgaggcccacctttgtccccctgcctgtgctctgggctggtgggatggtggcacagtcagctccagtaagccctgtgggccagaggcttttactctgcacctttactcagccccttagggaagaagaccccagatgaggccccagggcacagttatcaagaggctgagcagagcttggagccggaaactagagttgaaatccagctctgccactcaatggccatcgaacttcatctctttgtgcctcagtttcatcatttgtaaaatggggatataggctgtgcccgtctcattgggctggttgtgagaatgcaatgagtaaatccaagcaccttggcacatggtgagtgctcagtagatgttagctactgttctcaccacggaacccgctgagccccaggagccagagatccctgcttggcaccaacaagggacctgaggttgtgagctgtgcacagaaggccaggcccaggtccaggacggtctttctccagcccccttatgtgccaggctttgtcatcggctctctccacacccagcttttaggaatataattatgagacccacttccaggtgaagaaactgaagctcagagatgctgagaaactccccagctggtaagaggcagtcgggatcagagcccggattggctgttacttcaattgctcatctccagccattcacctggcactgaggacctgctatgtgccaggcactgttccaggtcctaggggtactctgcagagaaacatggatatgatgcctgccattcctggatttctacaagggcacgctgcctcaggagcaggggaaattcaggcctcaaatcttctgggcaagcattgttcatagggtcagctgagctatgcatggacaggtataagtggagcttgaagagttaaaaaataaacaagagccaaatatttctctgggtactgatgactgcttgatcaatgaagaaggaagaaaagattggggtgactggggctgcattaatagaggtttaataatcagaataaaggaggtgagagtcccacttgttgcaatctggatcagatctcatcagttctacactcgcatgataaggagaacatggggtcattgaacagatgatatcaaaagcagctaggatggcctgtgggccttggctgaagagctggggaggtgcatcaggcaaagaggcagcttacttggggcatcagtgttgttttcagctgcccaagggtgtcttatggactcacttcaaggaacttggagggccttaaggtcataacctggaccagatagtgaacattacagagttcttatgagaatgaactttgacctatcaaaatcctcagtaatgggaggcagttactagaagcagtgagttccttgtcacgtaaagagtgtgagcagaagctagaagatcatttaactagggcacttgggaggcgtgtcggactaggaagcatctcaggtttccatgcagctcatgcctagagtctctgcttttactgttccttctgtgtggaaggcgttccaggtagtgccttctcatcctttaggtctcagctttaatatcacctcctcaaggaagtctcctttgatcacgcaaggtaggtttcttcctctcccaccccactattctctatttcagagacctattgaattccttcacaggattttccacaatttgtaattatttagtttgttttacttgtttgatgtcgaatgccctcaaaagactgcagatgcaggaaggtagagaccaaattatctctgtttgttttgttgtcttgtttaccagctgtgcctccaatacctgggatatagcaggtcctcagtaagcatttcttggatggatggatggatggatggagagatgaactgatagacagatagatgaatgatggatggatgaatggatggatgagtggatggataagtagacgggtgaatgaatgaataaatgaatttatgtgtgggtggatggatgacttccagctcacatattttcaggtgtaaattctctgtgtgttcaggacatccttatatgtagattatcagcagagagctgagctatgtgcgtgtttcatttccagttcctgtggacaggaattatgacgtctctggggaatcactgtagtgaactgattagcagctaattacaggaggacattttatgttttgaccccagaattaaccacatgaactttgatgaagaggaaaatcaaggactgggtgaattcatttaaatttagtttaatatgtcctttcagcacataagcagctaataaaaatggacatctttcatgtgcaaatctcctcggaagggtcctccgtggatgttccagggtcacagccaattctctttgaagtgtggcccaaagatctctagaggcaggttcgtgagctttgttaaaatgtagattctggggcccaccccagacccactgaatgggaacttcggaagtggggcccaggatgggacatttctgaagcactcttgtccgagcttaggctcctgggaaaccatctcagacagaccctaacagataatgaaacaggccagccacgcacagtggctcatgcctgcaatcccagcactttggaaggcctaggcgggcagatcacttgaggtcaggagttcgagaccagcttggccaacatggtgaagtctcatctctactaaaagtacaaaaaaattagctggacgtggtggcacgtgctcataatcccagctacttgggaggctgaggcacaagcatcacttgaactagggaggtggaggttgtagtgagctgagatcgtgccactgcactccagcctgggtgatggaatgagactctgtctcacaaaaagaaagaaaattattatattaaaaaaaaaaaaagagaagcagcagctgaggccagagagggacagtgacctacttaaggtcacccagcaaatccatggcacagctcagactagaaccttctcttttgtctgccagaccaacagcctgttcttgatgatgggtgagagtgaatggaatttagggttaaaagtaatcatattgctcccatcttaaacttacattttccagtcccaattttctatgagtaatgtccattaaataattaatgttcctgaaaatagtctgggcttcctcatgcctttttattcctggaacatcaaaccttttcagatcataattaattaagactcttgatgtccccgagaggtagccagacacccgcagaaacttggtaattggttccgaataccaagagacacagtctgcattctagaatttccctgatttgagaaggggatgggactggagagagactaacgtggccccgagggctgccacgcaccaggcaatgtgcaagttgcttctcatatgttctcacgtctcagtcttgtgacactgggaggtacgtggaattatccccattttacaaatagaggcaatggaggctcagaccacccaaggtggcattcttcagcctggtggcattgaaggaggtggcaaatctgtgttacagaactcatcacattctcacaaattgaggtcagcgtggtgattgttctacgctgttttttgttttgttttgttttgttctgttctgtttagagatagcgtcttgctctgtaacccaggctggagttcagtgtggtccaaccatggctcactgcagtcttgaccatctgggctctagcgatcctctcacttcagcctcccaagtagctgggactacaggtgcatgccaccacacctgcctaatttttttatttttatttttttgtagagacagagtcttgctgtgttgcccagggtagtctcaaacccttgaccttaagcaatcctcctgcctcagcatcccaaagtgctgggattacaggcatgagccactgcacctggcctatgctggtttcaaaacacgctttgctcatggcttgaccacacttggtcagcgtggctgagaggagtggagtgagtgttcctgggacgcactaggagggtaatgaggaagggtcagcagagctggggcctggggttagacagaggccacgctgcaaagaacctgcctccaggcaaatagcttgttttgtgctatttctaaataaccactcctcacacccatcaaagccttcatgggggtaccacacacaaccacccctagctgttcattcattcattcgttcgttcaacaaatatttactgagcacctgctatgtgccaggcactgtctcaggcactggggaaacagcagggacctcggtggtgacacagacaataaagcagcagcaagttcattactgtgaacccttgaacaatgcgggggttggggtgccgaccccttaccccgtgcagtggaaaattcttgcataactttaaaacttaactaaccgcttcactgttggccaaagccttactgattacataaacacttgattcacagatattttatatgttttatgcattatatactgtgttcttataataaagctgcagaaaagagaatgttattacgaaaatcataaggaagagaaagtctatttattattcattaagtggaagtggatcatcacaaaggtcttcatcctcgttgtcttcatgtttaggctggggaggaagaggaggggttggttttgctctctcaggggtggcagaggcgaaagaggtggaggaggtggaaggggaggtaagagaggcagacacacttggtgtaattttatcacaaaaaatctgcgtataagtggtcccgcacagttgaaacatgtgttgtcgaagggttgactgtcattcattaattacccattgtcatccatgcaatgaaggtccagggtgttggggggcactgtagagagggcagttagggaaggcctctgtgcggggctgacgttttaggttgagaactgaaggctggggaggaagcagatgtggaagatggggaacagtgtgctgaggctcagagtgggggaaaagtgccataggattgtggactgtggactgtggaccagaaagaggactcccattcctgccactcctgccccaagaagggggagcaggtatgtggggagggcggggcgaggtggtcctggccagctgagaagtagtgttggaacatgagggtgctttagccccgggttaggaaatggggggccatggaggggtgggggcgaggagtgacacgggctgacttaggatgtgtaagcgccttgtggctccagtgtggactgcaagtgggggcaggtaggggctgtgggtggctgcagggagcccaggtaagaggtgctggctgcttggtctgaggagggagggatgaggcctgagccaagggcagacccagatatatctagcgcagggagtgcacctcacacaggctgacttctgggtatttggagactccctctgggccagggcagggacttttctcccattcaataggtgggaacactgaggcctccaaagtgaagtgatgtgcctgagttctctccggcaggtgcagcgctacacaaggcctctgcccacctttgtggcctggctggaccagggatcttgtccctcaagaagtaagcgagtccagctcaggagagaacccagccctgcaggtgctcagggcagacacagcctcgatttacagtgaacccctcccctggactggacaaggagggctcagagaggcttgagatggagcggggcttgggaggaggctgcagtcaggtgggggaagaagatgagaggcccgagcacagttacataatgacaatcagcagcagctgaggacaggcagctttgatggtggtggtggtggtgaggtggggcggggtggggtcgggggtagcaagagtgatcagagaggccttcctggaggaggtgaggaaaccacagaccaaagacgtggccagcagggtgtgagagatgccagtgagagtggagggtgggtttgcgtgggagagaccatctaggtgagaggatggggtgtgggtgttttaggattaggggtgaagcctcatcatctaggctgggaggcaggaggcctggcctgtggccccagttcttccctgagtgatcagctgcctagagtggccagtcacatcccctctggagagccctttcccctaactgagcctcgagggggtcctggttgtggcaaaacaagcattccccattcatggtaaaaataatctctccaaccctcttagaagatctgtaatttctttcatttctttcatatggtatatgttaaaaagtagttaattatttggatagcatactgttaaagactgtattacaaagttcatgtttaatgcagaaaaagacatttttataatcttgtctcttgaaaaagagatacacacaatttcttgtgaattaatttcttttgaattaattatgtaataaacggtacaatttgttgacaaatatatctttgaaggacatctcatgattaattttggggaataaatgcatatgaaagtgtagattgatgtttcattctgtacgtaattgaaaaactgctttcatagccggatgagagggatttgtgtgttttgtgcctaaaataaaagccatgggattattggtgaatttggaggttttgtttcaaattgactataaataggagagaaggctccaagctgatgttggtaagacccactcaggaaacccattgtggcgtgaatagcttttttcccctccaataaatgaaaagttaaattggttgtgcccatctctgtattttctctctttgtaattggtttttgtggtgctggaaacatatggatgtgttttataagaattctgatcagatggcaccaatgaaaggtagcacgaggcacatccagtgaattatcatttcagcggtgcccattcacttgtatttcaacttcactgtccctggcttcctgttcttagctaatattctgttgtgggtataaatgaaacaggtatgagtaagaatgtgagcaactggaactgtcaaacagtcaacatcctacaaacaaatgtaaaattacaacagtgataagattcataagatgcttataacactggaatatagtcggtggccaacaaaggttagccacggtgatgatgatgaggggtgctcagagagggagtgctctggagctgaactgctgtgtgaccatgggcaagctgcttaccctttctgtgcttcagtttcttcatttgcaacatggagacaattaaggtatatgcctcataggttcgttgtaaggtttaaatgaatgaacgtaaaaagtgcttagagtgttctgagcaaatggtaagagctaaaaaatgttacctatttttaaaaatcattatcactgttattctcataattagtcaaggaaggcttcccagaagaaatgacttggagctgagctgtagcagtagcaaggcaacaatggaggcataagcattccaggcagaaggaacagcatgtacgaaagtcgtatggtgggaacagaccgtggtacatttggggagccgaacagggctagtggggctggagcagagtgatcaaggaggagtgggaggagacctgaggctggagagatcagctgggggcctgaggaggtagggcctgggggcttttttttagggctgttagtctttatgctggaagcaataaatgccaacaaggggtttgtaagcagtggggaggcaaggtctccctgttgatttgcaaagctccctctagtggttttggggagggctgaggatggtggatgagggcttttggtggggtggggctgggagggatggagagatgattgcagagaggagtctaagatgcgcgcccgcaggagttggtgatgcatgtggtggttgtgaagggtgaggaagagaaaggggacaaggacaacgcccctctcttttggtttgtgtagccactgggtgggtagtggtgcctgagaatgatggtgtggggggtgagattacttctctgagcctcagcttccttatttgtgctcccagcctgtggtggggattattaagtgagagaatgcatgaaagagcggtcagcgcagcccccacaacgtgtctttttcccccagactcatcacctgggatctgcttccttcctaccacggcattggtggaatggaaggtaaatatcactcacgcccaagtccctggatcttgtttcctcatctatacgatagggacaagggcccttaacctacaggtttctatgagatttacaggatgacactttatgtgaatgaagggccgtgggcaagcctgggtccgagagacgtttcctcttcctacctcctcccttctgcagcatgccctaacagaaactttttttttttttttttttttgagatggagtcccaccctgtggcccaggctggagtgcagtgatgcaatcttggctcactccaacctctgcttcccatgttcaagggattctcctgcctcagcctcccgagtagctgggactacatgtgtgtgccaccacttccagctatttttttgtttgtttgtttgtttgtaaagacagggtatcaccacgctggccaggctggtcttgtactcgtgacctcgagtgatctgcctgcctcggcctcccaaagtgctgggattacaggcgtgagccaccgtgcctggccctgacataggtacatttacgtgcatgaaacatacgtgtacatacttgtgctcacacattcctcctgccaatttcttccctcaacacacgcatacatgcacacacttacacacacatttatggtacccacctccacacatcccttgaaaaattcaaactcagaaggtctctagagccccacttgctatcaatgaaaatacaatgcaaaccatatatatcattttaaggtatcttgtagacacattaaaagtacaaagtaaaagtacacattaaaagtacaaagaaacactgaaattaattttaatacgacatttcatttaacccaatatgtctaaaatatcatttcaacatgtaatcaaaacaaaatttgtttgaaacttattcaaacttattttgatattcttggtgggattttttgtgcggtcttaaaaatccatgtgtattttacacttacaagacgagtcacatttcaagggcacaatcaccacatgtagcttgtgctatgacactggatagcacaattagggattatctactcagaaccctcattcaacagatggggaaactgaggccctgagtggggcagtgactggccctgaagaatgcagcctggccgctttatcccacaacaccctgctgtgtaaggtatccaaggcccccatctacccctgctgtctgcagagtggccccggcaaagctccatacctggccttccagaagaggtgctgcccatgcattaatcaggctgggggtggcctgcaaagcctactcgtctatcattctctcctgggggtgcatcatttggaagcatcagggttccctgcagggagggaacacttgagtcctcccccttttcttacagcccccacatggggtggctggaatgcaaccacgtggaagccaggcaaggctgggacaaggggaacatggtgactctatctccctggtgggcctggtcctggggtcaggaaattcattctgcctgccttggttctgccattagctactgaggccagagttcacggacagtgggcagctgacccagatcccatatctcttcccagctgtgaaagcttctctgccaatcagccaccagagtcttcaaggctaaataagaggtaatgagtccgctagaaaaatgggtcagaggccaattaactcaggctcagatgtggctgagagcctgctttaactatggcaatgcctacagcacgaggcagagctgggggattggacctttcgagagaggggttgaagatggagcctcaaatgtctgaggggcccagggcttgcgggtgaatcagagtcccaggccagcttcctggggacttgctacctgccctgccacctggcccttggaaagcagacaagggcatatgccacatactcaatgctttgagtatcatctcatttaaccctttcaacaacacggtgtgagatgctgtacagtggctgtccccattttatagatgaggaaactgaagtgcagcaggggagggaacctgcccagagtctcacagtcagtaatgggaggagctgggattcacacccaggtgagcttgactctggggtagggctagaaggtgcactttctgttatagtttcacccagggtcaaagccaggctcatttaggccaggctctttcgtgcagccagatgtctctctgagctcttgttccagagagccagctgcactgggaggtatctctgtaggtcctgggtgcctcataccctccacactcaaacctgagctcccctgacctgcccctgccctgtccgcctcatggagacaggagactgtccacatggaattagactcccaaagccattctgatctcctgctgctccctcaacctcatacgcagtgatccatgcaacaaacatacactgagcatctgtgatgtgccaggcactgatctacgttcaaaggaggaaccagtggacaaaatcaacaaacattcctacgttccatctctcaggggctgactcaagaggaaacatgaataagcaaatgatgtgccccggggactgccttggaggatgtggagcagggtgaggaactgggaatcttggaggaggttgcaatatttattggggtagtcggagtgtgccttattgagaagctgacccttgagcaagattttaaaggatcaagagaatgagtcatgggggtattgaagggaagagcattccaaagaaggggaacagccagtgcaaaggtcctgaggaagaaatggcgcttgcaagctcaaggaatagcagagtgtgggtgaagaggaaggagtaggaagaggagagagatcttagcaggagatgaggtcagagagaagacagggagcgggcagatcatgcggggccttgtagaacaatgcaaggcctggctttgaccctgggtgaaatgatgccatctgatttaccttcaaaaaggctcacttggagaggggaggcagggaggccagtgaggtggctgcagccaaattcaggtaagagaggagagggtggctgggaccggggagaaggggtcagatttgagtgtgttgtgaagaccgagctgccaaggcctcctgatgggttggacaggttgacaattgagaagggggagtctgcaggtggggcaggtttggggaaagatcaggagtcccgctttggagctgtgatgtggaaagccctcctagacatcccagtggagctgttgagagagtcaggtttatgggcttccagatggggacagaggtctaggctagagtggctggcatgtgggtagatatggtcaccaagggctggcccccagggccttggggagaagaggagggatgaacagaggcaatgagaaggagtagttgcagggttggaggagaactaggagagctgagctgtgccgggtcaggtaagatgaggactgagcatcgcccaggagacttagcgatgtggaggtcatcaggggccatgtgggtgaggcctggcaggagatcctgtgtctgagcaatctataccttttatccatgtggcaggctgaatagcagcccccatgaggtgccaggcactaatccctgcagcccctaaatattgatattagcttatgtggcaaaatggtctttgtggctgtgataaggattttgagataggaaaattatctgctaatttatgggccctacatacaatccttataagagagaggcagagggagatttgacacagacagacagatggcaatgtgacaccgaggtagaaattggagtcatgctgctataagttaaaaagtggcacagccaccagaagctggaggaggcaaggaatggattctggcctggagcctccagagggagcacagtgcccttgactctttaatttcagcctagtgataatgacttcagacttctggcctccagagctgcgagagaataaatttctgtggctttaagccatcatgtttatggtaatgtgtcatagcagctacaggaaacaaacacgccccttctggcatcaggtcccctacttcccaccctccttagtcatcctctgtccctcatccaacaattgtcacagcctcatcaccaggctcctgctccaggctgccccagcacctgccctccccacacagaacctgatggggtaacttcgattcctaataccctctgcatggagcccacattcattagcctgaagcccagtgcttttcctgataaagccctaacagtctccacactcatttctcaccactggctcccaccacttatgctccataacctccatgcaattttcctttgctacatgttctcttaagcttctgagccattgtacttgctgttccctctgcctggaacacccttccctatcccagaaataggcatggtttgtttcctcatcgaatttaggtctttacccaaagagcttttctgatgaccattttaaaagtgcaactcccttttcagccccacattcctgattctcttcccctaccttgtttttctccgtggtgcttatcactcactatatatgtatttaactaatttgtttgttgtcttgtgcctccaattagaattaaattccacaggggcagggaatgtagtctgttttgtttacacttgtatctccaccaccaaggaatatgtctgacatgtaataagaactcaatagatatacgccgaatgaatgagtgggtgtatgaatgaatgagcaaaagagacaaaaaacaaaacaaaacaaaacaaaacaaaaaactaaccaggtgtggtggcacatgcctgtggtcccagctactcaggaagctgaggtgggaggattgcttgagcccaggaggcggaggttgcagtgagttgagatcatgccactgcactccagcctgggtgacagagtgagactctgtctcaaaaaaaaaaaaaaaaaaaaaagagactcagaaggagaggtcagtgatataggagaaaagaaagccaggagcacatgatatctctgaggccaagagagttaagtgtttcttaaaaatatagaaacttctgaatcatccattgtaaaaatgagtcaagtctaggtataatgctaatgtatttttattgcataaaactttttcggggatttgattattggcatggcctacctgtgagccacaatatttattcaacaaaagacccattcagctagttccgccaaactcttacattctctgtagatgaggacgccttaagtgctgagccctgcgctatgcttcatgctgtgattttcccaccaaccctttccatggggtctaggggcaggtaaacagagtggcccctcaccgtttcctgatcccatttccaggaagtaactagcaggaaaagcttgatgtgtagcatggtgtgtctatataaggagacacaaagctatgtcattttgaaagtggtagtccacgaatcctattatctcgcaactgttctccctccccagtcccagtcatctgtggacatctttccatgtcattattgaaagatctgtgtcatttctcccatcactttagggccacctcatcccaccccagagtaactatggagaccagtttactgtgcgcctttcctggtgtgtctgatcttagtctcaccatgatctgtctatataaacatacacatatatacacacaaacaacgctgtggggagggacgcacgccctgtcacagagcagcagctgctttctgcagaccagctctctcacctgggagtcccccacaacccattcccagcctctaagaagcccacgagcaggtgtgggctctccagggaggtcgtggtggggaaagcagccctttctgtgagagatgagagcggggagctggggatgggcgtgttaatagtcctctcttgcaacctacacatgctactttagttttagcaggtcatggcatcacacttgagtatcggcctgcgtcttgcttccttcactcaccagcttatcttagagcactctccatgtggaaatgtacaggtccaccccattgtgagtgagggcttcatagaattcaacaggatggccaggtcacactgtatccagcttccctcccagggatggatccccatgcagttccgatcttctccttgcacgtttggaggctggggctattatcaatatctttacacactaaacatttactttgtgtaggtagattcctacacaagtagtaggattgctagatcaaagggcaaggacatttaagattgtaattgatgctgctgccgagttattttttgctattatggtagcaagtcacactcgtcctccgtgcgggtgaatggatccagatgcacgtggttgtcagtccaggcagggaagtggatgagtagggaggcacaagggagcttaagaggaatgggggcgtgttctgcctttttttttttttttgaggcagagtctcgctctgttgcccaggctggagtgcagtggcacaatctcggctcactgcaagctccgcctcccaggttcacgccattctcctgcctcagcctcctgtgtagctgggactgcaggcgcccaccaccaagcctggctaattttttgcattttttttttagtagagacagggtttcaccgtgttagccaggatggtctcgatctcctgaccttgtgatccacctgccttggcctcccacagtgctgggattacaggcatgagccaccgcgcccggcctgcctttttttttttttaagagacaggatctcactatgttgcccaggctggtctcaaactcctgggcttgagcgatctacccacctcagcctcccaaagtgctgggattagaggcatgaggcaccgtgcctggcgtgagttctgctttgcagaaaggatgctgggggtgagatgtatcaaagacagtgcagcggagtggatgtcactccctcccacccctatgtggacttctttcctattcttcttttcttgtgggccttcttatattcctgggcaagagggaacatccagggtcaggctagtgagcacctccttacattttgcactttgtcccagacctggcaaaatcatacccattttacagatgaagaaagtaaggctcagggcagtgcaacgagtgtccaagatcacaggacctttagctgtgtcccttctccgaggactcctgtggaatgtaagggaggcaggatggggtcctccagggagaacagcctggccaataagcagaaggggcctggagtcggggtgattctgggggtgccactaacttagcttggcaatcctggctccccacctctcaggccacagctatggcacctggaaaatgggtgggtggacttagattaagggttacaaaaagaaatggctacagaggacccaggagacaagtagatctggccggtacacggttctgagactttgtggatgccaggcctggggtactgtgcaatgatggggcatgctagggcctgggcactagagatgatgtcctggctgaaggagcagcctctactcatgctgggagcagggtcccaggaggggaggctggtgcagtattgccagcattttttcttttcttttctgttttttaagacagagtcttgctctgttgcccaggctggagggcaatggtgcaatctcagctcactgcaacctccatgtcccaggttcaagcaattctcctgtctcagcctcctgagtagctgggattacaggcacacaccacaatgcccggctaatttttttgtatttttaataaagatgtggtttcaccatgttggccaggctggtcttgaactcctgacctcaagtgatccactcacctcggcctcccaaagtgctgggattacaggcatgagccaccatgcccagctccagcatttctttggagaaagtgaaaacttgggttttctttctctttttttttgagatggagtctcactctgtctcccaggttggagtgcaatggtatgatctcggcttactgcaacctcctcctcccgggttcaagcgatgctcctgcctcagcctcctgagtagctgggattacaggtgtgcgccaccatgcctggctaatttttgtatttttagtacagacagcgtttcaccatgttggccaggctggtctcgagctcctgacctcaggtgactcgcctgcctcagcctcccaaagtgctgggattacaggtgtgagccactgtgcctggccaaaacttgggtttttccagcagtatggagttgtgaaaggctggccattcgcggggtttgggagccatcccttaggcctcctgggactctcaaccctttgcaatcctcatgatcaaacactcctgacctttctgagccatgggcctcttctctgagcacatcttttaaatgcacaaaataaaaatatattagattacaaaggattccaattatgttgaaacatggttatcaaaatattaaaaacacttttgatatagtaataaatgtacttcttcattaatgcactaaataacaagcgctagggacaggtctaattagcatcttaactttgaagtggtactgggtgtaaacgatctatggagatagtagcaatgactgtaatgcgatatgaaaatatctatatttcttttggtgacaaagccaagaacaccactaatacaactgtggtttgttgttgacattcgcaagggaaggaaatgctaactttcagggcagtggtgctgaagagacagatgtaatattttttccacctcccaagattaccaactccctccgtgaggatcccctgtcattcatggggttaggggtgaacaggacggggctcggaccccagggtgaagtgctcatgaccagaggcccttccatggctaaaactaggggcgcaacaggagctgatccccagggcaggcctcccgcagcaggcaaacctgagatctgggaagggcctgcccttcctccctgcggccctggtgagtcacaaaacgtcctttctcaggaagaccaaatataaacagttcaggattatcttgagaacaagatgtttgtttactttctaaaattgcagacatggcaaagtgctgaggcctacaactgcaattaataataatttaggcccatcgctcccagggcagagctgcatctccgtgttagagacaaagacccatcttttccttgttttgtgttcaggcaacatgacgttatttctccctagtcatagatatttttattgcttgtatcaccccagattatacaagcaatacatgctcattgtaaaaatttcaaaatactacagaaagtaaaattttccccattttaactcattcccagagagaaccgctaataatgtattcgatccactgtgcttttcgtctccatgcctgtactcacacacattaccgttcatataatttctttttccaaatggcattctgtgaaaattgttctacaacttgcactttttttttttttttttttttttttttttttgagatggagtcttgctctgtcacccaggctcgagtgctcggctcactgcagcctctacctcctgggttcaagcgattctcctgcctcagcctcccaagtagctgggactacaggcacctgccatcacacctggctaatatgtgtacttttggtagagacggggtgtcaccatgttggccaggctggtctcaaactcctgacctcaggcgatccacccgcctcggcctcccaaagtgctgggattacaggcgggagccactgcgcctggtctcaacttgtacttttcactgaagatatcataaatattatttgttgatatgtctgtctcctcaattagaaattggagtttcagaaaaggaaatacagtactttataaatctttttaaatcaatgcgccttacccaacaattcatacataataggattcaacaaatatttgctgagctagtgaccaaattaataaatacataaatttgtttttcaaaaaataaattgtgaacacctttgtatgttcattaaacaatacttcattgttgcagggctcctgagagctaagttgtagggacgtgactgaatttttcaatgaccactcacaggtacatgggttgtttccaatttttcaaacctgttctgccccaaacatccttaaaacatatatatctttgtatgcttctttatgcattttttagactcaaagaaaggcctatttagattgtaccaaattacaaacctatcaccacagaatcttttttatctgttccctcaccaacactgagtgtttatttatttagtggatgtgaatgcactttattcaacaaaaatgaggcctatttcaaatatgccaaaggtgcttctataattctttctagtaacatttctaattggatttttattcttttgaatatttcaaaagataatatactttgaacaatttcaagcttgtggaaaaattgctagaacaatacatagtactaccatatagccctcaccaagatcatcaaattcttaacattttatcacattctggcttgtgcgtgtgctctctctctctctgtctctctgtctctctctccttccattattctctttctgaatctttggagggcaagctgcacacatagtattccatcatctttaaacacagtcgtgtgtatttcaccagaccaagttcattctctacctaaccccaatgcaaccctccaaatcaagaaatcaacatcagtacaaacaccaccacccaatccatggaccccattcaagcgtcccaacaatttgtcttttcccctctggtccagaaccttctccaagaacatgtattgcatttagttcttgtgcattttcagtttcctacaagctggaacagtttctcattttgccctgtcttttgaatcctcaatggtttttttttttttttttttttttttgagacggagtctcgctctgttgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccgaagtgctgggattacaggcgtgagccaccgcgcccggcctcctcaatggttttaaagggctccattctctagggtgatactcaactcagatccatctgaagtttccttgtgtccacactcagcccatgttcctgggcaaggaggccgcaggatgctgctgcattatttcagtgtatcatctcaggaggcacaagacggtgaccacctctggaggtgttaatctcgaccaccaggtcatcttggtgcctgccaggtttccccagcgtatttttattttattttattttatttatttttgagacggagtttagctcttgttgcccaggctggagtgcaatggcgcaatctcagcttactgcgatctccatctcccgggttcaagcgattctcctgcctcagcctcccaagtaggtgggattacaggcgcccgccaccaggcccagctagttttttgtatttttagtagatggtgtttcaccatgttggccaagctgatctcgaactcctgacctcaagtgttctgctcgcctcggcctcctagagtgctgggattacaggtgtgagctactgtgcccggccttaggtttccccaccataaactcaccatttcccttttgtaattgattggtatgttgtggggaagtttctgagatgatgccaatattttctgttccttgttaaacccccttcatggatgacttctggatcagtcacctttgtgatattggccaaatggtaatttttgtattctcatcattccttctatacctatgagttgatattctattgtaaaaaaagtcttttccttttcctttttgtatgtacgggtgtatttatatcagcaggagctcatggatttctattttataattcatttctatcattacctagtttgacgatcagaatcttgtctccagcctgggcaacggaataagaccctgtctcaaaaaataaaataaaaatccaggcacagtggcttatacctgtaattccagcactttgggaggccgaggcaggcagatcctttgagctcaggagttcgagaccagcctgggcaacaggacgaaatgctgtttctaaaaaaaaatgcaaaagtcagccgggcgtggtggtgtgcccctgtagtcctagctactttgggggccgacgtggggaggatcatttaagctcaggaggtggaggctgcagtgagccaagatcacaccactgcactccaacctgggtgacagagccagactctgttgaaaaaaccaagtcttttcccagatggcagggaccccttcaagaacacagtggctgccatgtccttttgctatgacttcatctttcattcaccatttccttactttctggcataatgagatattctaggttcatctcgtcatcatgcattttctgcctcagccttggcattagtcatttcttggagtagccctgattcatttcagtgaagggtgatatttacaaccaagatctgggcactcagtgtactcattacacctgggatgtaggtatatgtgtgtgtgcgtgcatgcacatgtgtgtacacacatactcctgcttattcaactaaaaattatttgcatgtgtgtctctctctctatatatatatgtacatacacacacacacgcacacacacacgaatcatgagtttataccaaaacctccaaatccaatccaatacctcaaggttatttctagccttctccttttacatttgtaaatatcttaggcaatgagaatcttggctctcattatccccaatatatgtactaatttattcaattgctttgcttatttgtttcatataacctatcttccaccatcgcaacatcctctcaccgtcctgcatctgcggctgctgtgactgtcagcccacacacctccacaaagccccccccgacaccaccgccccagccagcctcctcggccatgaggcccatgggcctcacactttggcatgaccccccacctccagccctgtgtccttgccactgactagtgccttcaccagcccacttcctgcattatttccaatcactcaatttggccaatcttacagtttcaacaaaaatatcaatgttgtcattttaactttttttctttttctgagacagagtctcactctgtcacccaggctagagtgcaggggcgcagtctcagctcactgcaacctccgcctcccgggttcaagcgatcctcatgccttagcctcctaagtagctgcgattacagccatgtgccaccacacctggctaatttttgtatttttggtagagatagggtttcatcacgttggctgggctggcatcagactcctgacctcaggtgatctgcttgcctcggcctcctgaagtgctgggattacagatgtgagccaccatgcccggcctcatttgaactccttaatcatcaacaaggttgagtatcttttcttgttgtttcttatttgaatggcttgttcatttattttgcccatttttctactatgttgagctattctcttcttgatatgagagttctttgtactgtagagatgttggatcttggttccttgcaaccaattatcttttgattttgcttatggtatatgttaccatttaacatttttatgtaataaaataagacttcttatttagggttttatattccccaagttttatatagatatatttttcctaccattttaaacattcagaaaatatatacctcgctcatctctctggaatatattttggtatttgaaggaagtttggaatttttttttcctcccaaatgtgtagccatttatctcaacatctttttttttttcggatgaagtctcactttgtcacccaagctggagtgtagtggcggaatctcgcctcactgcaacctccacctccagggttcaagtgattctcctgcctcagcctcgtgagtagctgggattacaagcacccaccaccatgcccagctaatttttgtatttttagtaaagatggagttttaccacgttggccccactggtcttgaactcctgacctcaagtgattcacccacctcagcctcccaaaattttgggattacaggcgtgagccactgcgcccagcccctatatattttattgtataatccataaacttctgactaatttgaactctgcctttattacaaattaaactttggtatacacttgggtgtaatttggattatccattctgtttccctcatttgtctgtttctttaggcaacacaatatgttattgattactgtagttttataatactacagtaatttttaaatatctggtaaggaaaatccccctttaatgttctttttaaaggatttttacagcattatacatttatttttgggggcagaatttagaattattttttgttaaaatccgaaaaagtgtttttgatattttaatttggattgcattaaattttagactattttgaggagaatatatatttttatggtgttagatctacatacaaggtacctatcagtattcatgcagtcttttcttatatgttaagtttctaagccgtgctttacatttctctgcattacaggctctgcacgtttcctattatgttcatccctaagaattttctgggtttttttttttttttttttttgctattgggaaatgaatcttttattccatcatattttctaactagctgttacttatatatgtcagagtatagagggaggaagtagtctctggtggttaaacacatgggctttggaataggaccacctgggttttcatcctggctctgatattcaaagctgtgtgaatgcagcctggtgacgtcacctctctgagcctatgtcctcatttttaccataaggataaaaataatacctatttcatggaaatgttcatgttacatagtaagtccttaacaaatattagctattatttaaaatttttgtaataagccattttagtgagctattctattgtatatatattttctaacttattatattgttattcctgtattatcatattatattgaattattattttatttctaatggtttatcagttgactctcttagatttttgggaaggtgattatataatatataaatattttgctgccttctttccaaaagttatatcttattttattttttctgtagagatgaggtgtcgctatgttggccaggctgatcttgaactcctggcttcaagagatcatcctgcctcggcttcctaaagtgctgggattacaggtatgagccactatgcctggcccctcttatattattttcttatttacttgtggatgccctgattctgttttatcagaagaaatgctcctatggctgaagttttgagtaagatgttagttattggagacataaatatgtctccatacagtagttatctatagatagctaaatacccagatatttagcttacaaaagttacaaaattatttttaacttcattataaattgatatttcattttagctaataccttttgggagggcatgaaggagatgactttgtcatttttctattttaacccattgatatggtaaatcatatctatagatttcctaatattgaaccatccttgtagtcttggtgcaaacccctgcttggacatattatggtagttatatgatgtactgttgtaagtgattcattaatattttatttaatgtttgggatcaatttgcttttttcttgttgttttcagcttttagtgctacttttatgcctgctttatttaaaattcaaaaaaattcttctttctaaatgcattggaacactatttttattccttaattatatttttaaaattgtattttaccatacagtaaaattgactttatttggagagtgtacagttctatgagttttgacagatatatatatataatcagcacatatcaaggcataggacaattccatcattacataaagctctcttgtggttgctaaccagcagggaaggcagaggaggaagggagggaagaggagtaagaggaagaagaagaaagaaagatggagggagggagagaaagggaaaaagagaaagagaaagaaaggaagggaggaaagggggaaaaagggaggaagggaaggagggggaggaaaaaagggaaagagaggtgaagggaaggagagaaaagtgtgagagagggaggagggaggaagggaaggctgaagcagggaggaaggagaggagagagagggagagggaaagggagaaggggagagaagatgatgatgatcagaaggaacttgtggaacagaatcaaacattcctcaggggttcccagaattgtttttatggggaacctagcagaaggatggattatggttgggaaggctaagagtcatagtaatttggatcttaaaattactttctggtcaaagactgttgaaacctgagaacatattggtgaatgtttgtttggaagtaactgttgaagcctattaattttcttctgaatacagctttaactgtttcagtttatttgtcctttcagccaggagttgttggtggggagaaaatgtctgaatttttattttttggtttgcctttactattaatttatgcttctattgcatgaagttcagagcttgtgaactgtactatatctactatacaaatctaaaagatatgtactatatcttttagatttttttaggtttcctttgtagcctagcacatgtcaaatattccactggcatgtgaagaaaaggaatattctctgttttctgtggacagagtttaacatattatatatacacatatttgatcaatgtcattaattatattatttaaattatttatagctttaattatttctgagaggagggagttaaagttttctattcttgtgtttctcctgatttcacattgtatttatctaagagtttttgcttcatgtcttttgatgttacattatctggaatgatgtcattgacaatcattctcattgtgttttacatcctttatcagcatgggtaatgctttgtctcatttgataatttttttggtttcatttcaactttgttgatattagtgtcatgaatcctaatttcttttagttcatatttgcccggcaggttcccaaaaatcatttctttaaaattccttcccaatcctttccttttctctcactccctcctgcccccatcttaactatccagttactgatatagtttatcacatgtttttactttctaaaaagagatatatttatctctcttccttgatttcttagctcaagatacaaaacaatgtataatagtgtatagtgagtctctaccataaaaaattacaagatctgtggattcatacttcctccttatttcaactttgttatgatctgagatttttatcacaggccattgtaggtattccattttaattgtttatttttacataatatagattttctttgaggagttataattttgacttaaaattaaatttcacagtttttgaggcttgattttatatttaaaaggatccaagattcacttttttttccccccgagatagggtctcactctgtcgcccaggctggagtgcattcttgcagtcatggctcactgcagcctccacttctgtggcttaagtggtcctcccatctcagcctcctgagtagctgatggtacaggcatgcgccaccacacccagctaatttttaaattttttgtggaaactgagtttctctatattgcctaggctggtcttgaactcctgggctcaagtgatcctcccacctcagcctccccgagtgctgagattacagatatgaaccactgtgctgggcccaagattcacttcttaacctcttctttacccttccttcaatagctttcctattcctgacttctttattttgaattatcttttggttttctgggttttattattttctttttctttttcttttttttttgagatggagttttgctcttgttgcccagggtggagtgcaatggcgtgatcttggctaaccgcaatctctgcctcctgggttcaagcaattttcctgcctcagcctcccgagtagctgggattatagacatgcacctccatgcctggctgattttgtatttttagtagagacggggtttctccatgttggtcaggctggtcttgaactcccaacctcaggtgatccacctgcctcatcctcccaaagtgctgggattacaggtgtgagccaccttgcccggtctgggttttattattgaaaagcattttttaaaagaaatgttgatgaatcctacagtccctgaatttaggtacttctatgcacacaaggaagattatgtgagatgatggatatgttaacaatttgcttgactgtagcagttattccattgtgtatatgtacatcaaaacattttattataccttaaatacatacaatgaattttttagaaggaaaaaaagctaaaaacaatgacaaaaataaaaaacctcacatccgtttattaggtataaagtttttaagtcatacttttatgccctcaaacctctgcagatgctatgctggtcttctgatatcaaatattaatatggagaaatcaatgggggcagtctgatattctccctttaattggtaacttggtattactggcgaggcacttatataattatccttcttaaatgccttaagttgaagatctttatcacaatatatctagattttcatctttctctactaatgtttttttgaaagccatatacttttcaatcttcacattcagtattttttctttattatatgatggatcatttccatggtacattttttctgttctctcctttaaggatgctacttatcgttatgtttacttccattgtgtgtcatacataacaatcatctgctctaaattgtttctgactctttgacctttttcctttgcattttgggtgatttttctattatcctatcttgaattctccctctttatattcctgctgttgtcagttctgtcctggctgtttcttatctatttaataagaacataatccaattattctggttcacaacttattaacttggctctgcaattcttccaatcttatcctgctaaattttcatctcatctttggcttttttgagactatgatacatctgtggtctaattttttttttaatgtttctaaaatgtcttcttctgagatgaaatcttttttttttttttttttgagacagagtctcgctctgtcgcccaggccggagtgcagtagtgcgatctcggctcactgcaagctctgcctcctgagttcacgccattctcctgccccagcctcccgagtagctgggactacaggcgcccaccaccacgcctggctaattttttgtatttttagtagagacggggtttcaccctgttagccaggatggtttcgatctcctgacctcgtgatctgccccgcctcagcctcccaaagtgctgggattacaggtgtgagccaccgcgcctggctgccttgagccctttcctaagggtactaatttcattcatgatggcggagccctcatgacttaatcacccctcgaaggcccaacctcttaataccatcactttgggggttaagtcccattgcatgaattctggagggacacataccttcaaagcatagccgtccccgttgctagcttcagaactgctattcttggtcatttaaaagtgtatgtctatttgtggttgtcattctattcaatttggggagagagacattgagtgagcctgcatttactttaccatctttcctcggatgtttcagataattttagagcaaacctcacaaaataatttagttattcaattccatatttcaaaagtagctgtaattactctttgcggcacattttcatatcaccgtttccttacattacctcatttaatcctctggcagcctattgagataggaattattatgcccattttctagtggctttcactcatccatagcagtgagttgatgtggattagatttgttcaactctaaattttgtgtcttttccactacactgcacttcttttcaaaaaacgaaataataacctcctggctctatgctggcgagtgcgtttgtcagagaaattggatgctacaaggcatcacttactgtatctactctacctaagggcatgtttaattgaacttaattggaacaactacccagggttttaaatttttattattattttttactagctcactcttaagccaaaaactcaccctcatttaaagcaggtgttattataaattcaactatatataaatgtggtgttcgtctctgttggaaataggagaaatataacaaaagcactggctcaccattgggttgggattttcagcctgcctcctttttccgttccactgtgggatggaccactttcttgttatgcagaggaaaaaacactgtgatccttgtcttggctgtgtgaccagaacaagttacttaacatctctggtcttcatctctctctgctgggaatgaaaatataaggtcatatactcttcctacctttaaggtttcagacttcatgaaatccaagtctgggaactgactccagaccatagcttcagcatgggctttgctatattgctgggcagtcttgggaaagttccttcctttctttgggtctcagtttgcccatctgtaaatagccttgttaggtaagttcagtggttttcttttctttttttttttgagacagagtcttgctctgccacccaggctggagtgcaatggcgtgatcttggctcactggaacctccacctcctgagttcaagcgattctcctgcctcagcctcctgcgtagctgggactacaggtgcctgccaccacgcctggctaatttttgtatttttagtagagacggggtttcaccaagttggccaggctggtcttgatctcctgacctcaggtgatccacccgcctcggcctcccaaagtgctgggattacaggcgtgagccaccatgtccggccagctcagtggttttcaaactgtgttccaaggaacactaggaactgtggaggtggaaacagaaagactaggcttgtgctttatatagtccacctctgggtaaggttacatttgtaaaaagtgttctattgttaacaaatgaaaaaattgttctgagatatttcgtcccatacagtctctccctgaaggagatttctccaggtgaacgttcttagaaactaaaacttactaccttaagcaccattttggtttgatattgaatggaaatcaatataaagtggaattagacatcttgccttatttacagtaaggcactgaacattaactttttcttgctgttaaggatcactattttgaatatcaacgtgactcactgatgtcttgaagacatgggcaggtgaaaatgaccctcggccctttccatgactgtctccacatgactcttccttccttccttccttccttccttccttccttccttccttccttccttccttccttccttctttccttcctcttgctctgttgctggagtacagtggcacaatcatagctcactgcagccttgaactcttgggttcaagcagccctcctgcttagcccccgagtacctaggattacaggtgcgtgccactacacctggctaatttgtaaattttttggagatgcagagtcttgctatattgcccaggctggtctcaaactcctggcttcaaggggtcctcctgcctaagcctcccaaaactttgggatcataggtgtgagccactgtgcctgccaagtatgcttctttagtttgtatactgttttctgtgattccctctttaccccatggctgtcaggaggtctgaagtccttactcctttttgcattgaggggtcctcctaggctctgagaagaaagtctccccatctttgtagcctacttttctctccacaaatttagagccagaaacctggttgtctcaggacatctttcttttttttttttttgagacggagtctcgctctgtcgcccaggcctagagtgcagtggcacaatctcggctcgctgcaagctccacctcccgggttcacatcattctcctgcctcagcctccagagtagctgggactacaggcgcctggccaattttttgtatttttagtagagacggggtttcactgtgttagccaggatggtctcgatctcctgacctcatgatctgcccgcctctgcctcccaaagtgctaggattacaggcgtaagccaccgcgcccggccgtctcaggacatctttattggttactccaaagattacctccaatctaacaccctcccttcacttccccagcgacagcctctttcctgcgaagccttctcctctctgtgcatggcaggaacccgtgactcattttggattctcccatcttcctcagcttcgccatccaattagttaccctggccagtcctggttctgtccccaagacagcttgataactttcagcacatcctttaacctctctgggccttagtttcctcaggaaggaagaaaaggaggtacagaaagataaaaaggaagaaacgtttactgagctccttctccttgctataggcaaggaatttgacaccaaccagattggttcagatccatccttgctacttgttagttttgtgctcttggcaaaataacacattccctttctgagcttgtttcctcatctctaaaacgggggtggtaatatgtatgttgaggaagaaatgacagtgggcctggcacgtagtaagcatttggtatatgttagccagcgtgcctgtcctccctcctgtctcccttccgctttccttccttgcctcattgagagcctgtttggctgtatttttccatccaggcaattactctccccacaagtgtgtgcattgtttgggagtcgggctgtgagatgaggttatgagttgcaaacacaacagctcctccagcttctgtcgctggcctacaaatgtcacgttcatccaaatagcaatttcagggcacacttctttcctgatttgttagtacttctgaaaaattaaatggagagaactttgaggtgccaaggaacatgatgaactcattgcagaagcagagccagctcttcctccaccctccaaagctctaaaattagactcagcaaaccctgcgaggagagctcagcccactcttgaccccaaagcaaagggtgtcctgtttgccatgaggtcttgggtagcctgaaggcctcagtttgggggacagaccctcaagactgaagcagagcctatgacgtctctccctccctctgtctacttccatctggaactaggtgccactggagatgctgagcagtgacgagccacatttaattgtttcctcttttagaatcaactttattggggtataattgatgaatgatcaaatgcaccaggccgggcatggtggctcatgcctgtattcccagcactttgggaaggtgaggtgcgtggatcacctgaggtcaggagttcgagaccagcgccaacatggtgaaaccccgtctccactaaaaatgcacacacaaaataataataataataataataataataataataataataattagctgggtgtggtggcacatgcctgtaatcccagctactcgggtgactgtggcaggagaatcacttgaacctgggaggcggaggctgcagtgagccaagagcgtgccactgcactccaacctgggcaacagagtaggcctctgactctaaaataaaataaaataaagcgcacccatttcaagtgtccaattcaatgggctttgacagatgtccacattcatagaactatcaccacaataaaaacatagaacatttctatcaccccagcaatttttatttaaaattcagaaatattataaccatccagaaatgttcagagattaatataatgaaataatgcttacaaatctaccaccaaggattagcagatgttactgtgttgctacatttgctgtgatttgtcctcatttctttctctctctctccctcccttcatgtccactctgagaaagaaagaaaattaaataaaaactcttttaaagaaatgaaacattatcagtacagtcagagccttccttatcccaatgctcatagataactactgtcactacccatgttttaaagggacatgtcttactcatgtttaaaaacttaactgccctgtgcatgatcacaaaaaatatacagctttgttaggtgggcttttgacatttatgtacaataatggtgtatgtgtccttttgtaacttactgtaacttgacatgtgctttaaagattcattcaccttttttacaagtagatctagttcatttgccttaaattagtattctagtgtaagaaggttttaaaatttactaacccaatcccctactgataggcatttaggctgttctctttctcttcccaataacatcagtgctgcagtgcaaatcctgagcccatgtataggaattactcttttgggatatttatctgaaagtggaactgttggctcagaaggccccagggcatgaacctctccagctttgctagatattgccaaattgctctcccaggtaagagtatcaacaccctcttcctaaaagttcctgtctttcccatctcctctgcaacatttggttagatttttttcccccactctgatgtttatgaaatagtcttttggttgctttaatttgcatttccttggtcaacagtgaagctgagcgtgtatttataaatttattgggctttagagtttcttctgtgaatgcttgtggatgtttttgtctctttttccgtttgctttttaaattggattgtaaaaattctttatgtattatagatattaatcccttatcagttatatgtatcgtaaatattttctccaagcctgtggcctctctcttaattttggttttggtgctttttggtcatagaaattttaagttttaatgcagtcaaatttttctctgtggtttatgctttttgtgaattgtttaagaaatccttctctactccaacaacattttctacactttcttctaaaagagataagggttattcttcccatttgacagataaggaaatggaagaggtgacttgtccaaagtccacggatgtaggtggcagatccaggactggcccgctgtgtgctgattctaaacccagcatgcttttcttcacttggggccctggtgttgagagccggatctgggaagcagatgatcgtggttcagtgtggtcttgacctgtggtggatggacactgggcggaccatgtcctctctctgtggctcttcttggtggtcctatggtcagggaggctcatgacttttcctttgccggatgtgtcagtgaatactgagttcctaaaggtcagctttggaagagatttggggccatgtgttatacatggagaaactgagaccctgattgggggagaaagttgctctggacttgcccgtggcttatcccacctgccaaggggcacagttccagcactgcctggctcccattctgaacccacttgggcctcgccatcctggcctggccactggacaacagtagccaccaatggggaggacacaggccacctgccaggtgactgcacatctgccccttgactttgtcctcatagcagccttagggctggcaactgtcatctccattttacagaggaggaacttgaaatttagagagggtaattgatttggccaaattcatacacagaggcaggaaaccctgatccccatgattccaaagctcatcctgtgtgacccaggatcctgctctgtattggaggtgactgagtcaacactgaagaagcagctccttctctgattgaccctcaactgttagagaacctgtgtccccagccccacgtagtcacctctgccctgagcctctcctcagtgtctcagagcctcaaaccctgactcagtctcttgtcttatttatttatttatttatttatttatttatttatttatttatttttgagacagagttttgctcttgttgcccaagctggagtgcaatggtgcaatatcagctcactgcaacctctgcctcccaggttcaagcgattctcctgcctcagcctcccgagtagctgggattacgggcatgtgccaccaagcctggctaatttttgtatttgtagtagaaacaggggtttgccatgttggtcaggctggtctcgaactcctgacctcaggtgatcctcccgcctcggcctcccaaagtgctgggattacaggcgtgagccactgcgtccggcttggtctctcgtcttaaatcaaggaggttttcatagctcatggcccatccacacacagcctctgccactcccacatcagactgagtgggcagggaatgtcctactttcatccattcattccatcccttattcacttaattttaactgggcagagagtcagggtgacgtgtggcctggtcagagtcctgtgccatcttacttaactctcagagcctcagtttcttcatgtataaaataggcacaatgaacactcaactcctcaaactgctgtgaaggttaactgagaggaacaagcctgtggttatgattccatggccagtttaccatggggtctgtgactgctgcctcggctctaccatctgagctcagggctgcctggcctggaatggaggggtgggtaagagcacaggctctgaagccagagtacctggattcaaatcctcccaccaccctgactagctgtgtgattttcagcaatatactaagctttttggtgccacatttcctcatttaaaaaattatgttaataataatgcctaccctatgacattgtcatgaatacgaaaaaaagttaatacatgtgaaacacaaagaaccatgtaattatagacaaaactgtgtctcctccaaccccaccccagattcatatgttaaggccctctcaatttgactgtatttggagatagggcctttaaggaggtaattagggtgatatggtttggctgtgtccccaccaaaatctcaccttgaatcgtaataatctgcacatgtcaagggtggggccagggggagataattgaatcatgggggcagttttccccatactgttgtcatggtagcaaataagtctcatgagatctgatggttttataaatgggcattcccctgcacaggctctcttgcaggcaccttgtgagacatgactttgctcctcattagccttctgccatgattgtgaggccccagccatttggaactgagtcaattaaacctcttctctttgtaaatgacccagcctcgggtatgtctttattagcagagtgagaacagactaatacatagggttaaacgaggtcataagggaagtgggggcggggctaatcagatgggattgatgtccttgtaagaagagaagagacaactgagatagctcttccccccatgacctttccctctctttcttgtgtgcacagaggaaaggccatgtgaggacacatcaagaaggtggccatctgcaagccaggaagtgaggcctcaccagacgccagccctgctgactcctgatcttggactttcagcctccaggacagaaataaatttctattgtttaagccacccagtctgtggtattctcttatggcagcctgagcagactaatatgccaaactcatagtttgtgctgaagaaaagctaattatttgataataattttatttattattattaatacaattgtggttgtaactgaaagaccagattcaggtatctcctgcagtgttgataagggggtggcagggtgagggactggggctagtatcagcaccctgcccaacaaaggacttcccctcccaggcagccaacagaagaggctgggccaggctgcaggtggtcggggaagcctggcttccttgtcacttctgcctctcatcaccggtgcacaggcctgctcagggccaagggtaccagaaagctttgcctgtgctgtttctctgacccagtggcctctcctttttcaattgcctaactccaggacagaaataactctgatgcccctttcagacctgccccctagggcacccccttagacattggtcagtaacaggagagaagatcgacagattagaggtgggggcatgggaagctctcttctgattgtttctcttttacaaaatgaaaagcaaggtcaacagctgagaatgggagggggtgggagttggagatttgaggggagcggagataaggaatacaggttatcttacttttggttgctcaaaagcagaccccaagacaaggatcccagagcacgtagtttatttgaaaggtgatcccaggacagccaggtaggggactaggagggtgaggcaggaagggaaaggagccaagcccattacgatggtgggcagctgaatgcaggtcaatcccactgggctatcgtgggtgccacccaagatgggaggggaccggagtgatctacattccagctaggggtggtttttgcttaaaggttgctcctggttgagaggtcaaatctctgcctccagccctgctccccaagaaagccctagccatgcagatgagggcaattagcattggggcagcaaggaaagggtactggccaggggttgtgggtgggaccctgccaacatctgctatggtgaaggagtgaattaaccagcagtaagtagaggtccctcagggctaatgttgattggtttaaagtgaaccaaagagcataagttgccaaaggaccttagtcatcgcagactaccatgcctggctaatttttgtatttttcgtagagatgggatttctctgtgtttgccaggctggtctcggactcctggcctcaagactggcttacagatgacatgaaccataaggcccctagaagaaaagacacttttccaaaatcactcttagcatggtcaggatggcagatcacattcctctggaaccttgcacagaagaaaaaataaaaaaaagtttaaagcagtttttagtatacaaaagtaaaacatgattattggagaaaatctagaaaatatagacagaaaatttaaaatcacacagaaatgtgtaacccagagacaaccactgtcaacaatggatctgtatctttctagtctatttcctaagcctatgtgtattcatatagtttttttcaacaaaatttcaatcacattatatgtaatagtacatactgtcctctaacatgattttttcatgttacagtataatcatgtttctctttccatatcattgaatatttttctgcataaatgtctagggccacacaatattccattgttaaacactgaaattgtttgtattttttcattattataaataccactgcaatgaatttcccagaaattcactctgagcatgaccatgaatatttcctaagaataaatccctaggaatggaattgccatctcaaagggtaagcactttttaaggcatttatttgataatttgccaatttgataaactttgctaactttggaaacagcatgactgtttattcaattgctcagtccaaaattcttgagtcattctgtgtataatagttctgtactttgtggtaggatttctgtagggtcctttcaagtgggacataaaaaggaatgttcatttgccattttgataacactgccaaattatcttctaaaagtatttaaccaaattgaatgttcttatctaaaaacacactatttctctctctctctctttttttctgttaaatgcttcaggagagttaaattgttgttcctttttcatagacatcatgcacattataaactttattcttaggtatcttttgagttttattgctggcatgaatgaaattttaaaaatcggtcatattttctagttggtcattgttgaaaacctaagaaaactatagattttagcatatttatttatttatttattttagtattattattattatttttattatactttaagttctcaggtacatgtgcacaacgtgcaggtttgttacatatgtatacatgtgccatgttggtgtgctgcacccattaactcatcatttacattaggtatatctcctaatgctatcccttccccctacctctacctcacgacaggccctggtgtgtgatgttccccaacctgtgtccaagtgttctcatggttctattcccacctatgagtgagaacatgtggtgtttggttttctgtccttgcgatagtttggtcagaatgatggtttccagcttcatccatgtccctgcaaaggacatgaactcatcctcttttatggctgcatagtattccatggtgtatatgtgccacattttcttaatccagtctatcattgttggacatttgggttggttccaagtctttgctattgtgaatagtgccgcaataaacatacgtgtgcaaatgtctttatagcagcatgatttataatcctttgggtatatacccagtaatgggatggctaggtcaaatggtatttctagttctagatccttgaggaatcaccacactgtcttccacaatggttgaactagtttacagtcccaccaacggtgtaaaagtgttcctatttctccacagcctctctagcacctgttgtttcctgactttttaatgatcgccattctaactggtgtgagatggtatctcattgtggttttgatttgcatgtctctgatgaccagtgatgatgagcattttttcatgtgtctgttggctgcataaatgtcttcttttgagaagtgtctgttcatatccttcgcccactttttgatggggttgtttttttcttgtaaatttgtttaggttctttgtagattctggatattagccctttgtcagatgggtagattgtgaaaattttcttccattctgtaggttgcctgttcactctgatggtcatttcttttgctgtgcagaagctcttcagcttaattagatcccatttgtcaattttggcttttgttgccattgcttttggtgttttagacatgaagtccttgcccatgcctatgtcctgaatggtattgcctatgtttccttctagggtttttatggttttaggtctaacatttaagtctttaatccatcttgaattaatttttgtacaaggtgtaaggaagggatccagtttcagctttctacatatggctagccagttttcccagcaccatttattaaatagggaatcctttccccatttcttgtttttgtcaggtttgtcaaagatcagatggttgtagatgtgtggtattatttctgagggctctgttccgtccattggtctatatctctgttttggtaccagtaccatgctgttttggttagccttgtagtatagtttgaagtcaggtagtgtgatgcctccagctttgttcttttggcttaggattgacttggcaatgtgggctcttttttgcttccatatgaactttaaagtagttttttccaattctgtgaagaaagtcattggtagcttgatggggatggcattgaatctataatttaccttgggcagtatggccattttcacgttattgattcttcctatccatgagcatggaatgttcttccatttgtttgtgtcctcttttatttcattgagcagtggtttgtagttctccttgaagaggtccttcacatcccttgtaatttggattcctgggtattttattctctttgaagcaattgtgaatgggagttcactcattatttggctctctgtttgtctgttatcggtttataggaacgtttagatttttgcacattgattttgtatcctgagactttgctgaagttgcttatcagcttgaggagattttgggctgagatgatggggttttctaaatatacagtcatgtcatctgcaaacagggacaatctgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtgtgctattggctgtgggtttgtcataaatagctcttattattttgagatacgtcccatcaatacctagtttattgagtttttagcatgaagggctgttgaattttgtcaaaggccttttctgcatcttttgagataatcatgtggtttttgtctttggttctgtttatatgctggattacgtttattgatttgcatgttgaaccagccttgcttcccagggatgaagccaacttgatcgtggtggataagcttttgatgtgctgctggattcggtttgccagtattttattgaggatttttgcatcgatgttcatcagggatattggtctaaaattctcttttttttgttgtgtctctgccaggctttggtatcaggatgatgctggcctcataaaatgagttagggaggattccctctttttctattgattggaatagtttcagaaggaatggtaccagctcctccttatacctctggtagaattcggctgtgaatctgtctggtcctggacttttttttggttggtaagctattaattattgcctcaatttcagagcctgttattgggctattcagggattcaacttcttcctggtttagttttgggagggtgtatttgtctaggaatttatcaatttcttctagattttctagttaatttgtgtagaggtgtttatagtattctctgatggtagtttgtttttctgtgggatcggtggtgatatcccctttatcacttttttttgagtctatttgattcttctctcttttctcctttattagtcttgctagcggtctatctattttgttaatcttttcaaaaaaccagctcctggattcattattttttgaagggttttttgtatctctatctccttcagttctgctctgaccttagttttttctgctagcttttgaatgtgtttgctcttgattctctagttcttttaattgtgatattagggtgtcaattatagatctttcctgctttctcttgtgggcatttagtgctataaatttccctctgcacactgctttaaatgtgtcctagagattctggtatgttgtgtctttgttctcattggtttcaaagaacatctttatttctgctttcatttcgttatgtaccctgcagtcactcaggagcaggttgttcagtttccatgtagacgagtggttttgagtgagttttttaatcctgagttctaatttgattgcactgtggtctgagagacagtttgttataatttctgttcttttacatttgctgagtagtgctttacttccaactatgtggtcaattttggaataagtgtgatgtggtgctgagaagaatgtatattctgttgatttggggtggagaattctgtagatgtctgttaggtccgcttggtgcagagctgagttcaagttctggatatccttgttaactttctgtctcgttgatctgtctaatgttgacagtggggtgttaaagtctcccattattattgtgtgggagtctaagtctctttgtaggtctctaaggacttgctttatgaatctaggtgctcctgtgttggatgcatatatatttaggatagttagctcttcttgttgaattgatccttttaccattatgtaatggccttctttgtctcttttgatctttgttggtttaaagtctgttttatcagagactaggactgcaacccctgccttttttgttttctgtttgcttggtagatcttcctccatccctttattttgagcctatgtgtgtctctgcacgtgagataggtcttctgaatacagcacactgatggatcttgactctttatccaatttgccagtctgtgtcttttaattggagcatttagctcatttacatttaaggttaatattgttatgtgtgaatttgatcctgtcattatgatgttagctggttattttgcttgttagttgatgcagtttcttcctggcatcaatggtctttacaatttggcatatttttgcagtggctggtaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctggtttgcaaattctttcctttaagaatgatgaatattggcccccactcttttctggcttgtagagtttctgccgagagatttgctgttagtctgatgggcttccctttgtgggtaacctgacctttctctctggctgcccttaacattttttccttcatttcaactttggtgaatctgacaattatgtgtcttggagttgctcttctcgaggactatctttgtggcattctctgtatttcctgaatttgaatgttggcctgccttgctaggttggggaagttctcctggataatatcctgcagagtgttttccaacttggttccattctccctgtcactttcaggtataccaatcagatgtagatttggtcttttcacatagtcccatatttcttggaggctttgttagtttctttttactcttttatctctaaactttccttctcgcttcatttcattcatttaatcttcaatcactgacactctttcttccacttgactgaatcggctactgaagcttgtgcatacattatgtagttctcatgccatggttttcagctccatcaggtcatttaaggtcttctctatgctgtttattctagttagctattcatctaatctcttttcaaggtttttagcttctctgtgatgggtttgaacatccttctttagctcggagaagtttgttattactgatcgtctgaagcctacttctgtcaacttgtcaaagtcatgctctgtccagctttgttctgttgctggtgaggagctgcgttcctttggaggagaagaggcactctgatttttagaattttcagcctttctgctctagtttctccccatctttgtggtcttatctacctttggtctttgatgatggtgatgtacagatgggattttggtgtggatgtcttttctctttgttagttttccttctaacagtcagggccctcagctgcaggtctgttggagtttgctggtggtccattccagaccctgtttgcctgggtatcaccggcggaggctgcagaacagcaaatattgcagaacagtaaatgttgctgcctgatccttcctctggaagctttgtctcagaggggcaccgggctgtatgaggtgtcagtcagcccctactgggaggtgtctcccagttaggctacttgggggtcagggacccacttgaggaggcagtttgtctgttctcagatctcaaacttcgtgctaggagaaccactactctcttcaaagctgtcagacagggacttttaagtctgcagaagtttctgctaccttttgttcagccatgccctgcccccagaggtggagtctacagaggcaggcaggcctccttgagctgtggtgggctccacccagtttgagcttcccagccactttgtttacttactgaagcctcagcaatggcagacgcccctcccccagccttgctgccaccttgcagttcgatctcagactgctgtactagcagggagcgagtctccttgggcatggcaccctctgagccaggcatgggatataatctcctggtgtgccatttgctaagaccattggaaaagcacaatattagggtgggaatgtcccgattttccaggtaccatctgtcacggcttcccttggctaggaaagggaattccctgatcccttggaccccttgtgcttcccaggtgagccgatgccctgccctgctttggctcacactccgggggctgcacccactgtccaacaagccccagtgagatgaacccggtaccttagttggaaatgcagaaatcacttgtcttctgcgttgctcacgctgggagctgtagactggagctgttcctattcggccatcttggagggtgacttcagcatatttatttttaggccgcctgccttactgaatctattatgatttctaacaggttttcaattcattttcttgttttttttttcccctaggtggaaaataataaaatgtttaaatattaatcattatacttattttcctaatagttgtatctctaatttcattctcttgtctagtgacatcggtagcacctccagaagagagaacaaaagcagtggtagcaccaatctccttagtcttttctcagattgagggggcatctcatgtgtgtcttccctttgaaaatgatgccaacactcatttgacgtacacgtgcaaatgtttttgttgtggaactatccttctattcttgttttatgaaacattgccatcggggatagatatattacttttaaaaattgtattttagagccctgtgtggggctcatgcctgtaatcccagcactttgggaagctgaggtgggtggatcacttgaggttaggagttcgagaacagctagaccaacatggtgaaaccccatctctactaaaaatacagaaattagccaggtgtggtggcacgtgcctgtaatcacagctactcgagaggctgaggcaggagaatggcttgaacccaggaggcagaggttgcagtgagccaagatcatgccactgcactccagcctgggtgacagggcaagactcagtctcagaaaaaataaaaaattgttttttagatatttattgaaacttttttccttttatattaacagcctaccaaattttgaataacccttgcttattctcacaatttttcttttaatgttctatttagtttatttgctaatattttgttattttgcatgtatattcataattgggtttgtagtcttccattttgtgcttgtctactttttaaatatttaattctgcataatttgtaacattaattgaaaattttctttcattatgcattgggatgatttaaagggcaacagatttctatgttgtttggatttttgaaagagttctacttcatctgatgtgattgtggttctgctttctgcttatttgtttttcctggaacaatttttttgaacaagttttgctggtcctcttactcatagtctttctgaatcattttattttacttaagtgtttgtggagttatattttatgtgttaatttaagcttttaaaaaatatctgtgtttattccattttcatttattgtcatagtaatttctgtttaaaaatgttcttaggttattttgtttgttgtgattcatcacagtataatttcctttatatcttttgctttactgttcataatttttaaagtaattgaatgcccatatagattctgcttttagatctattgataattgaataacttgatcaatcctcgttctccagttcatgagttctagcagtaaggccttcccctttgtctttctctatgaaagagaaggccaactgcacgtttttgcttcctctcattctctcctccgtcaatatcaattccaaatccacctcacccgatttgtgtatcctgaatttttgccccagcctattataaggaacttatcattaatatttgtattaggtgtctttctttgtcaaggaacttaatgtttttgttctttcttataacaatactttccatggctatttagtcttcatttcatgtttggaatttggatgcagtttggatggatttggctcttaccccaggctttctgcaacacagacttcatgttcagaaatatatacttattcaactagttcttgagagagtgtttatgtgacctcctcctaaagttttctgatgtttaataacagcctgtttccttaccaggtgactggcactttgactgggcttagaatttgggggcttagaacttgggaccatattccttttcttcctttaaaacactgccttgtcttctggcagtgaattgtatggcagaaacatcagggtcgtttttcttcagtgtagatatttacagacatttttctttataactaaaatgaaataattttttatgagaacttgccttgaaactgcctcctttgttcctctttcatattaggaaagatctctccttttatgtttcgaactctgtttctgtctttttttttttttttttttttggagatggagtctcactctgttgcccaggctggagtgaagtggcgtgatcttggcgcactgcaacctctgcttcccacgttcaagcaattttcctgcctcagcctctcgagtagctgggactacaggcgcacactgccatgcctggctaatttttttgtattttagtagagatggagtttcaccgtgttgcccaggctggtcttgaactcctgagctcaggcaatccacccgcctcggcctcccaaagtgctaggattacaggcgtgagccaccacgcccagcctctagtctcttctttaggagcaccaattatcctatactccatctctttttctttcctctgtggttttcctcaatcctttgtcttttgcttctacgttctgcattattttctctcaaggaccctccatcttgacaacctgggttccttcaatgatgaatccgttctcccttcctacccatttaaaaaatgttgcagtagcgttgcttgacctcttactgttttttcttagcattgcccattcttttgtaaacccaatccatagttacaggagctcatttttcatccatttttttctttggagtccttgaactttttcccatgccactgagaatagaaagtagatttgccccaaattttcatctgttttatgggttcagtttatagaaatatggtcttcatctctctacgctgctgtgttcatttccttgtcattggttgctaagttcttgcttctcactctcttctcacctttgaataggattctatttaggatttgtacttgccttgggctggcatggatagattttccttcatgattcctcacactttgcactctacccttaggtatttgggtagcttcagaatcgtcttactagaactctataagtgaatatatatctggatgcattttgagagattcagaaggatgcaaaaccaatagaaaatattggttactttaaggtaagattggagggaaatactattgacctttaatttaaaaacctctcttaaaaaatgggcaaacattaagaatatcagatagaatgtacaaatgactaatctgctatgtaaaaagatgtttgaccttgctgatagccagtgaagtgcaaactaaaaccacactaagacatcatcacttgcacatcagattgaaaaagatttacaatgttataatgtccaacatggtaaagatgttgagaaagatgcactatttcaagatttttttttttaaaggaacttggagactggatcaggtaacttaattttaggaatttaaaactcagactgaaatgggcctatggacaaagtgggttaatttagtctttattttgtttttgctaaataaatatttcatgtatgtttaagaaaccttataaacaaattcagtcacagactttagtttgcattaggattaccttcagtttttctgtacttttatgttttgcctcaaatgtgatttcttcactgctttatcaagagctggacctgacatcaacattataaaataaatttacagagctcgagggcttcaagtgcctgtcaaggtgacccagaagcccacatcgatggttcttgccatgaactctactctggagaaaccacagaaataggataaaacacggactggaggaactaacaaaggagtgttggaagcccctggaagggtctcatggctgctttgagctggagtgtatgtatatgggtgcacacactcgtgtatgtaggaagcagaaaaggatgggacaagcaaaggcaatgatgggaaggtgggttagagcagtgatttgcaatcctggtgcatgttagatatcatctgagaagctttaaaaaatattcacaccagataacagggaaatataggagaatgtcctcctccttagctgatgttgaattactagctgtctgcaacttatttccaaatgcttcaacaaaacaaaacacctcgtaacagagaataagagagagagaatgagagcaactgtggcaacttttgatgaatccaggtgaagacagcagtgatgttctctgtactattttttttaagactgatttgttggtttgatttttgttttcaaaatacaatgttgagaaaatcaatactcacctccaagcctcatcccaggtattctgatttcattggtctgtgatgcagtggcatctgaaaaatgttccagatatgagtgtaatgctgaaccaagattaaaatccacagggttggcaggaagcttttaaaaagctcttctcttgctgcttctcctgaagtgccttgataccatctttgacttccacttcaccatagaaattggaagcaatagtccaaacctccagtgccagtaaacatggtgctgggtgctctgctgagtgaggaattgatgcaaaatgaaaccccaactagaggagctgtcagttacaatggcagcaaagagcagtggctaactgttgttttgtggtacttgagcttctctactcagaggctcatccctctccttaactgacattcatccacagggacacagatgagagcctggcccttgaggtttcattcatactctgctaaacaaagtagttgattccactgtgggaaaatgaattcacaggccaagatatctagacacctgagaaatacctgtcttgttaaagagaaagaaaaaaaaaaagacaaatggaatgcattccacctgaagcagcattattgagagatggcttcagaatttaaaataaacattatagaaataattaagaaaataagagatgattttaagcatatgaaggaaaagtaagaaatcatggacaagaaccaagtggaaatatcgagtatgaaaagtataatagttaaagcaaaaaatacaagagatagaattaataaaaggatggaaacagctgaagaacaaattaatgtaatggaggattaggtagaggaattattctgaggcagtaggaaatgatgaagagggagaaaaatatatattttcaaaatgctttgaaatatggaggacagaagtaaaagtgttaatattttaaaaatgaaaacactaagagaagaaaaaaactgagaagatgaaatatttaaagaaacagtgaagattcagcttcctaaaattgaagacaagtctctggcttgaaaagtcctatagaacaccaaacaaaagagataagaaaaacctatacttagctgggtgtggtggctcacacctgtaatcccagcactttgggaggctgagacaggaaggttgcttgtgtccaggagttcaagaccagcctgggcaacatagtgagaccccttctctacaaaaaataaaaaatcagctgaatgtggtggtgtgcacctgtagtcccagctacgtggggggcctgaggcaggagaattgtttgagcctgggaggttgagcctgcagtgagccatgatcatgccactgcactccagcctggtggatagagtgagattttgtctcaaaacaaaacaaagcaaacccctcaaaaaaacctgtagctatattagagtgaaacgtaagaacatcaaagacaaattctaaatgtttttgaagttgaagcagattgccaacaaacaagaatcagaccgacgtcaagtgggtactacaagtgatatgaaaaacacggaagactagatataaatatagtcaagttcaagaaataaataaggataaataaacttgagtatgggtcttaaattaagggcaactgacacaaggcccaaagcaaaataaataaattttgaagcagcaaaaggaaattctccctacccaaaagaaagttggatagaagaaggaaaaaagaaaaatccctgtaagtgtaaattgtgaaatacattataacaataataataataaatgaaaatggattaaattcactaattaaattcacagacagctcagagtagattttttaaaagaaagagacaatattatgtttttaaaataagaaataagcaatacaaaaaggcaaagaaagttgaaaaatcagactggattccaggcaaatatgaaaatattgataatctggcaatttcaacacgtgacaaaataccatttaatgccaaaacatcataatgaacaaagcaagaggttatatactaataaaaggaacaatataacaaaaaacccaatacaaatatatacgcacctgaaaatagacactaaaaatatatcaagcaacaagtgacagaaccacagggagaggataattcattattcccagttgaatcttttattgtattcctccaaggaatggacagattaggtagtctaaaaatgatcagaaattattttttaaaatcttctctttgctcctagtgttccgaaatttcacgatgatatgtttcagcatgggtctatttttgtccgtctcacttggtactcatgggccttttcaatctggcaattcttgtcactctcttagggacatgttttattgttgttttgttgctgatgtactcccctgtgtttctctgttctctctggaactcctcttatttggatggcatcttctggatggtttctctagttttttttgttttgttttgttttgttttttatcttttctttcctattatctatatctttgtctttttgatctactttctgggagatttcctcatctatagcttccaagcctgctgctgactttaatttttttcatatcgtatttttaactttatgagcacttttttggtttcagaatgtcgcttttcttaaaatagaatcctgttcctatttcatgtttgcaatacttcatccctttgagggaactaatactttttaaaaaagagattttcttctttctggataatttctgtttctctaaatacccctgtactggtttttgttgctgctgtaaaaaaaattaaaacaatgtaagtgtattatcttatagttctgtaggttagatgttcaatatgggtttcactgaactgatatcacagtgttggaaggatcatgtttctttctggaggttctagggctaatctgtttccttgcctttttcagcttttagagaccagtcacatttcttaactcatagcctgtttcctcacatctctctgtctcttttctagttgccacatctccctctgaccatggcaaagaaaagttcttggcttttaaggacacatgtgatttgactgggctcactaggataatccaggataatctcctcatctcaaaatcagatcattaacaactttaattccatttgcaaccttaaatctgcaaaagtgccatgtaacataatacattccctggttctggggattcgaacatgcacattttgggagggcattattctacctaccatatcccatccccataacctctctctttttttgtttagttttgttctctgattttcactttggaggttttcctcacatgtctggtaatctctagctatctgcacatacttaggaatgaaagattaaaaagtttattggaagctctgaaaacatgagtggagcttattggctgtataactgtggattatttgacagactatttccctgggcaatccccatgtcagtatatcagggtctttcttgttgggctggtcaattccccagagaagacttgtacagtctcctccctaaaggcagaaggcctggccacccgagttacactatctgagcaggggaagaggcttaagaatctcaagatctgggatgtgtgtgtttagacttaataattctcttgtgtctgtcaattatacctgtcatcccttttgcaaaaactagacattcagtcatctgcctgggtgtaaagattcagggggaaaatggggcagaggagttcaaatgtctcttaaacagaccttcagcaactcttgaatttttagtcaaatcctcacctttacttccagagatcctggacagcaattgctgagtgactcgggggttctttagtataaactgggttggttcttgaatttaccctccgtgggcttataactcaactttctcagtcctcggcttgtctatctgctttccagtttccaaaattttgatgttgctttttcccattggtccttgccttattggttttttgttaaaaccctttattgttgctataatggcatttccaaagaaagcagagctcaaagcttgggttcaattcattatttttttaactggaagttggtacattgttccatatttgttgaacccactgtgcaacgtgagccatggaagtgccctgtcccactgtggatgcctcttctgactgacatatttctcctttttgggggcggaccaaccatatcaaagagatgtcaaactaaaggaaaagctcataaccataggctttctgtgttgaaggttgctatgacttttaatggcaaaaaccacaattatgtttgcaccaacttaataatattcccaacccaacaggtatttgttgaagatattggtctatcgctctgaaaatatttcccaaatgatattttccagcctccctgattctgcctttgccttcctgacatccatgtgtgtgctcacttgtgcgtgcttgcacacagacatacacacacacacacacacattttcttccttttttggagtgtacccttatcagtattaagaatctgactcagaacaatggggagggctttagtcttcttgttcagctattaccatggctcagaatgctgtctatgtcaggagatgaatccctgatttttttcatggcccgtccatgtctttccctcatgccaccaaattgaagataatgatataactttgcatttagttttatagccataggaatatccagcaccatatatgtttaaatacaggataacccagaacataaaacacctccattccttttccagttgagaatattctccagaattttggccaatttaagtataaataacctttagaaccttattgaaattgatatttacttatacattttattggagtagtttcattatatatacaatttaaaattatatattataaaggtaatttaatttactgcttttttcctactcatataataataaagttgtaagaaacaattttactgaaactcctcactggcgtcttggacattagtgtctctgtcgtcagtagatccattttttttaaatcgtccagcacagttttccacagtacattgtgttcatttccatttgagtcattgtgacacgtttatgtttgtatctatatgtttgctcccacggaaacttttatcccaagccacaatagcccattatgtgcggacagatttttggttgtttaatttgtcctgatggtatatgtgcatgatttccacagacaaccgttttctgtattgattttcaagtgagctttagaaggattgtttacaaagacatttgacacttgcaattgtgaggtgatagacctttagcaataattactaaatctgtgtcaaatttctttgccttccttatttactgattctgtcaggtgacatctctaatcattgcaaaccagtgttgattgaggtcatttcaggctgatgtttctttgccaaacaagatttttgttcaaaataaagaatttgaggctgggcacggtggctcatgtctgtaatcccagcactttgggaggccgaggtgggtggatcacctgaggccaggagttagagaccagcctggcccacatagtgaaaccccatcgctactaaaaaatacaaaaattagctggacgtggtggtgggcacctgtaatcccagctacttgggaggctgaggcatgagaatcgcttgaacctgggaggcagagtttgcagcgagccgagattgcgccactgcactccagcccgggcaacagaacaagactccatatcaaaaaaaaaatttttttttgaaggtgcatttccataatagtgcctttccaaattggtcttcttgttcagccttattaccatggatcagaatgctgtctatgtagggagatgggtccttgatttttttcatggcctgtccatgtcttttccctcatgcctcttcttatagattacccagtctcaagtattctgttatagcaacactaaatggactaagacactttctcttcagacatccacaggactctctccataatatgagagatttttttaaggacgcaaatttagagtaattcttttctgagagttaatttttagaaattattgtatttggagtagatttcacactcggttggttttattgcttattgttggtccccttttatcatgatcttctcatttctgggtccaacactttggtctaatagccagtgggatttaagtgccatgattttaaacatcatttacgcactgatgattctcagtgttgtacctccagtcttgacattttccttgatcttcagtttatatattcatctgtcaactcaacacctcctaagcctaaacctaaattgatgtttaataggcatctcaaaattgaaatgtccaatacagaattagttctccaagagttggattttataaagccaggatgccccttgggtttagtctttttgcatgtatccactgcccatttgaccttctctaccatgttatgctgtagaccaatagccctcaacataagcctgagccatacccttgaacttcccagcttgcagaactgtgagctaaataaacctctcttctttataaattacccagtctcaggtattctgttacagcaacaacactaaacagactaagacagtcttccttcagatatccacaggactctctccatcatttaattcaggtctctgttaagatattatcttcccaactgcagtgccactccactgacatgcactagtcactctgtaacccttcattctgtgttatttttctttataaaacttaccattccatgctagtgcatatactagcatttactagtatatgctagtatatgcaagtatatgttagtatatgctagtatattatagtatatgctagtgcatatactatattatattactataatttaaatatttattatttacattatacttatttgtttattttctgtttttccaccagaatgtgggcttcattaaggctaaaactttgttttgttcatgatttattctcagttcctagcaccaagtctgtgttcaataaatatttattaaatgaattaacgaatgaacaaaccagttttccatacgatggatcacatatttagttctcctttcatcctttttcttttacccactgcattcctgctttctcttttataattttcacccttattcttttatcactgcattcctgacatcttatcaacatcgatgacttgatatgcatttgttttgctgcagtactttattactgtagccacagtctaaaattctgccatagcattgtttatttcttatattattagtttctcacagtaaaaacaatctcaaccaggcttctgttcatcccattcttctgcattattattttgtctctcatcttacattttataggctctacattttcttgaattttattgggaacttaaacttttcttttagcaagtgattttcttcagaagaccttttcttttgcttccctgcagagtgtttagcagtgtctcaacatccacacagaaccccaaagtgaagaatgggagatgtggtggtctgaggcatttaaggaaatctctctttaatctttagtggctgagctaaccaagcagagacttcagcggcaacatgtgacaaagaatatagactttacagaataattccaaaggacactaaaaaaaatggcagcagcaacaacaaataataataacaaactctggagagggggagaatctgatttccagagttgccatattatattattttaaaggtcaacttttttaacaaaaaatacaagttatgcaaagaaatcagaaaggatggcccataaacaggaaaaaggggcaaaaacaagagaaactacactaaggaaccccagatgttggatttattagacaaaggctttaaattagctatttaaaatatgcttaaagcatgaaggaaattatgtctaaggaactaaagaaaagtttaaaaatgtctgatgaaatatagaatatcgataaagagatagaaattattaaaacaaaaattctggagttgaaagtacagtagctgaaatgaaacattcacttagaggagctcaacagaacattttaacaggcagaagaaaaagaagtcagcaaacctgatgataggtcaaatgatattatctgtctgaggaagagaaagataaaaagaatgaagaaaaatgaagagtctcaaagacctatcaagcatactgagatagaccaagaatacaaaaatatgcataatgtgatttctagaagagaagatagagtggcagaaagaatatttgagaaaaaaaaggatggctaggttgggtgtggtggctcacgcctgtaatcccagcactttggggaggccgaggtgggtggatcatgagttcaggagattgagaccatcctggctaacatggtcaaatcccgtctctactaaaaatacaaaacaaaacaaaacaaaacaattagccaggcatggtggcgggcgcctgtagtcccagctacttgggaggctgaggcaggagaatggtgtgaacctgggaggcggagcttgcagtgagcctagattgcaccactgcactccagcctgcctgggtgacagagtgagactccgtctcaaaagaaaaaaaaaaaaagggatggctaaaacttcccaaatttgatgagaaacattaatctacacattcgagaatctcaacaaactccagctaggataaactaagaaagatccttacctagacacatcataatttaactgttaagaggcaaagacaaagagaatatcttcagagtatcaagagagaagtgactcaccatgtataagagagccttaataagattgtcagctcacttttaatcagaaaccatagatgtcagaagacagtgggttggtatagtcagagccctgaaagacaaaaaactgtcaaccaagaattctatatccaaagaaaactatcttttaaaaatgaaggagacattaagacattcccagaaagacagaaatggaggcagtttgtcaggtatttcagcctgaagcttttctacaagtaatactaacgaaatgttcagtccttcaggctgaaatgataggacaataggaagtaactcaaatcgacataaagaaataaaggtaactacataggtaaatacaaaggccaaaatacatacaaaaggaaaaataaatttatttttttctttgtaaccctttttttctcttatttgttttaaaggatagcgatatgaagcaaaaattatgaatctatgttgatggtcatacagtgtgtaaagatgtaatctgtatgacaaaaatagtacaaaagttggagagggaatgaagttatattggagaatggtttatgtatacaattgaaatgaaggtaataactaggttgttataaattaagatgctaattataatctccagggcaaccactaagaaaataactaaaatatatatagtgaaagaaatgacaaaggaatactagaaaatatctagtacaaaagaaggtaataatggaggactagaagaaacaaaaaaaagaaacatataaaaacaaacatcagaatggcagacataaagcctaccttatcagcaattatatgaaattactctacataatcaaaatataaaacttttatgttttgttggacaccactgagaaagtgcaagactactcagaatgagagaaaagttcaaattatatatctgataagggacttatatctagaatatataaagaactcctacagttcaacaataactaaacaaataacccaatttaaacattgtgcaaaggatctgaatatacatatctccaaagaagatgtacaaagacaataagcacataaaaagatgccaaacatcattagccagcagggagagaaatgcaaattaaaccaacaatgggccgggtgaggtggctcatgcctgtaatcccagcactttgggaggctgaggtgggcagatcattaggtctgaagatcgagaccatcctggctaacatggtgaaaccctgtctgtactaaaaatacaaaaaattagccgggcatggtggcgggtgcttgtagtcccagctacttgggaggctgaggcaggagaatggtgtgaaccctggaggcggagcttgcagtgagccgagatcgcgccactgcactccagcctgggcaacagagcgagactctatctcaaaaaaaaaaaaaaaaaagccaacaatgaatacattttttgtttgtgttctttttaagagatgtggtctcactatggtgcccagactggagtgcagtagctactcacaggcacattcatggcatactgtagcctcaaactcctgggctcaagtgatgctcccacttcatcctctcaagtatctgggactacagacatgcaccactgcacccagcttaaaacaatgagatagtacttcagaccactagaatggctatgataaaaatgatggacaataataaaggttggcgaggatgtagagaaattgggacatgcctacactgatggtgggaatgtaaaatggtgcagctgctttgaaaaactctggcaattcctcatgaagtcagacatacagttaccacatgaaccagcaattccattcataggtatatgatccccagaattgaaaatctatgttcatacaaaaacttgcacagaaatgttcatagcagctttattcataatagccaaaaagtagaaagaacccaaatgtccattaactgatgaatggataaacgaaacatggtatatccatacagtgaaatattagtcagccttaaaaagggatgaactactgatgcatgcaaaacacagatgaaccttgaaaacattttgttaaagaagccggacacaaagagtcacatattgtatgattccatttatgtgaaatgtctggaaaaggcatatccatagagacagaaagaagattagtggttgccaggggcttggagaagggggtaatgcagagtggttgctaatggttacagagtttctttttagagtgatgaaaatgttctggaatttgatagtggtgactgttggactactctgtggatgtatgaaaaaccactgaattgcagtttaagggtaaatattatagtgtgtgaattatatctcagttttaaaaatgggacggagttgtacctagacctctaatgtgcaagggacttcctcctatgtcctacctctatcacctggacatgtctaagtggccctcctgccatcaccttgacccctcttggtccctgtattagtcaggtttcttcagagaaacagaaccaataggatatcaacatcaatattggcgttgacaccagtatctatattgacaaaaatattgatatatggagagatatagacacatagaaagaccagctgttcacccaacaagctccttcctgtcccctttgggagctctattctttatactcccagtaactagctaggattccatgactagaatcatcacttctatttccttcttgttgtgaggttaatgaggggatacatattgagcccagaacctggccagtccagggactgtggatgtcctggtgagggtgactggcgacagctcctgagatgtagaaaatgagaatctatggttctttgaacagtgcctggctcctgagaccctaacctctatgcattgactagaatatgctcagctttcttaaagactagaattaaaaatctaataatattacaattctgctcaaaaccttcatcgactccccattgcattctaaataagagcctaagtttagtctaacattcccttttctagaatattatcccagtccacctgtctagtctcctgtgcaatattccctcagtagctgtcattcttctgcaggacacttgaccaaacattccagaaaacctggcgtctccatcatgcattgaacatgccatttggcacaatgccattgagaaactggacttgggatatagggagacctgctcaggaagtccagctctgccaaagactagctgggtaaccttgggaaagtcactctaccttctgtttagtttccttatttgtcaaaatgaggaatgagtctacctgtctcagtcggtggtcacaaggtttaagagacatagagcatgtgaagagccttagagaactaatttggcctagtctagcatccccttcctgcaggaagaggccccctctcctactccctccctctggttctgtgggtggccagtcattgccacttttacttctctggacacacaggtgaggaagtggatctctttgggaactttcaagttggaattaaagaaggatcgcctctttaggatggaagagcctggaagatgtgaagtaggggggcagtggtgcccatgtggcccagaaagccagtgtgtaagcatggagagagtccaggcggcatttaattttgggttctggttatttctgcagccagctgcagccccttccacgtaaagcaaattcactcatcaattacccttttacccaagctggattaagacaggcttctgatccttgcatgactgatgaactcaggagtgagggattgggggacccttcccagactcctcgttgctccaggtttgtgttcttattctccactcttacctttcccatgagatctgaggctctgtctaggcagggaattagtcatttgacttgctcctccctttgagtcagcttggggttcaatcagtgtttgggcttaacccctgaggctcaggcaacatcagcagggcagtgagagccgttgctcagggagtggaggtacttagaaaactttgagataggtgccaggacttctgccagcttccaagggagaactaagtttggacttctatgaatctcaatggctaaaccaccttcatttccactcagatgcactaaatccaaatttctggaatcaaggcctgagaatctgcatgtttttcaagcatccgggtgattctcatgtgacctaaacttgacaatctctgggctgagtcttttatgaagccccgagttcatcgttttacttcttcagattcctgagtacagcagtttggggaaagttataaccaaaacaagccagcgagctagtttcttatgctaatggtcacacagatctcataattacatggaggacacaagtgtctcataattagcgtctgctgttctgttcttggggggcaattgttctgcaacaatggccaggctcagtgctggaccaccagcctccctcagctcactcccctccaccacattccaatctcatgagagaagagcccctagttctcaggactttaaccctcttcctgccagcacccccaggccagtgctgaggtaggggaggttcgtgatctgatgccgggcatccagagggaagtgggagaaagaaatgtggaatgactgagtactgggggcagctagcactttgcatttaaggctgtgtttctcactcagacctaacgaagcataacttacagggttgaggcgcaggaaccccccttggtaattctgattttactaggatttgagactcactgaccaaatctttacctctttcaggctgacaagttgtctaaaagggcaggaggacttactcctgacatgcatctgccacccaaaccatcacaatagccttccgccttctcagtgggagtacgagtgaccctgcagcagaaggcagcaggaggtggtgacaagaatacacgtctggccctaaaacctgggtcagtcacatcctggctgccattcaccagctatatgattttaggaaagtggattcacctctgagctgcagattcctcatcaataaaatgaagacaagaacacccacccttagtatttgggtatttagactgtttccatgttttttttatttcttttatcatattcttggcattacgagtttagcattcaaggttctgaccaataagtgatcccaggggtgttcatgaaaatccccggggaaagcttttacaaaataaagaacggagtctattgagctggaatttgtaagggcatgactcaggaatggagtatttggagaaagttcttcaggtcttcctaatgcacacttttatcttttatttttaaatttttttattattcattattatttttttagagacagggcctcactctgttgcccaggctagagtgcaatggtgcaatcgcagctcactgcagctttgacctccagggctcaagtgatcctcctgtatcagcctcccaaatagctaggtctacaggcatgtgccaccatgccaaactaattttttaaacatttttttgtagagactgggtgatacggtttggccgtgtccctgcccaaatctcaacttgaattgtatctcccagaattcgtatgtgttgtgggagggacccaggaggaggtaattgaatcatgggggctggtcttacccctgctattctcatgatagtgagtaagtctcatgagatctgatgggtttatcaggggtttccacttctacttcttcctcgactttctcttgctgccactacatgagaagtgcctttagtctccctccatgattctgaggtctccccagccatgcggaaccgtaagtccaattaaacctctttttcttcccagtttcgggtatgtcttcatcagcagtgtgaaaatgaactaatacagtgggttttgctatgttgcccaggctggcctcaaactgtcctcaactcatcctcctgcctcggcctcccaaactgctgggattacagatgtgagccaccatgcctggcctcctaatgcatacttttattcaaactcatctgtgagaggcctggaaggactttgacatggtaaaaaaaaaaaaaaaagtgtgattttgcagaggcattgatttaaattgtgtacactgataatgttagagcaagtttgttagcagggagtgagcccaggcaagtacccagcatagacctgtctgtctcctttctaagatttccaaagggctaaacaagctttacttattatcttatttaatcctaaatttgtattgctgctctgggctactccccaggcccctagacccatatatccagctacctgcctgatctctccacttggatgggaataaacatctccagtgttgctggtcccaactgaaattctgattccccccaaacctgctccagtctcaacctcaatggcaacttacttaatgacaattaaattcttatgatttattgggcattttgaatatatccttaaatgttccctttctctcacaccctacatcctattcttaagcaaattccactgactctacccttgcaaaacatgcggaatccaaacagttctcatcatactcatggcaacctctctatcctaaggcactttcacctctctcctgaataattgccatcatattaaggcaatgtctctgatgctttttttttttctttttagagacgaagtcttgctctgtcgccaggctggagtacagtggcgtgatctcggctcactgcaacctctgcctcccgggttcaagcgattctcctgcctcagcctctcgagtagctgggactacaggcatgcgccatcatgcccagctaatttttgtatttttagtagagacggggtttcaccatgttggccaggatggtctcgatctcttgacctcgtgatccacccgcctcggcctcctaaagtgctgggattacaggcgtgagccaccgcgtacggcctttttattttattttaattaattttttgagacagtgtcttactctgtcgcccaggctggagtgcagtggtgcaatctcagctcactgcaacctccacctcctgggttcaagcaattcttccacctcagcctccggagtagctgggatacaggtgtgcgccaccatgcctggctaatttttgtatttttagtagagatggggtttcaccatgttggccaggctggtcttgaactcctgaccttaagtgatctgctcacgttggcctcccaaagtgctgggattacaggcttgaaccaccgtacccggcctagacaagaggcttttttatcccagtctcccaaatctctctgagctatgccatgccaactctgcaggaatccaggcaactctagtcagtgtggacctgaaaaggaactgaattctctgtggcttttttgctcattgtttccacttgagaggaatcctaaagagaaaagtggaagaatcgtttgcacaaagatatttatctctgggatgggtgcggtggctcacgcttgtaattggagcactttgggagaccaaggtgggcggatcacgaggtcaggagatcgagaccatcctggccaacatggtgaaaccccgtctctactaaaaatacaaaaattagctgggcgtgatggtgcttgcctgtaatcccagctactcgggaggctgaggcaggagaaatgcttgaaccaggaaatcggaggttgcaatgagccaagatcacaccactgcactccagctgacgacagagcgagactccatctcaaaaaaaaaaaaaaaaaaaaagatatttatctctgaattgctggtttattcagtagaatctttgagaattacaagtctgagctccagagcccaatgttaagaggtctgggagaagaggccgggtactgtggctcacacctgtaatcccaacactttgggaggcggaggcgggtggatcacctgaagtcaggagttcgagaccagcctggccaacatgaggaaacccctgtctctactaagaatacaacataaattagccgggcatggtggcgcatgcctgtaatcccaggctgaggcaggagaatcacttgaacctgggggttgggggcgcggaggttgcagtgagccaagattgtaccactgcattccagtctggatggcagagtgagactccatctcaaaacaaaaccaaacaaaacaagagatctgagagaagagaaagaaccagtaaaagacaccaaaaagaagtgacctgggaggtaggaggaaaacaggaacgtgtggtattctggaaggcaaataaaagcgtgcctggaggaagattcctagaaataagatcagtaacaggtctactagcagaaaaaaagcaatgaatctccactgaaggatatgaaataggacttcaataaaagaagacacatctttgataggaagttttagtatagtaaggatgtctgttcttcttagatgagtgtttaactcaatgtaattccagtaaaaacaccctactcaaactgataggaacttaacgaagttattataaatctgggacaattggtatacaagaatagaattgaatttcctgaaaagtaaacataagaagtggaacttgccctacttgtttaccaaaacatctaataaaggtaaattaatggaaaccaaaccacaggcgcatggagtgatgaataagggtgccgccgagtgcagacttgggctccagcatcacggctgttcagcggataatgaaattgacacttcacatttggggaggaaataatgaattacttattaaattttatttaaattagctagtcatttagattaaaaaaaaaaaaagctagaaactgtccctgagtcttattccaaaagagacttcagaaaaatggaagataaaaagaaaaaaaaaaatccatacagtataaaagagaacacaactgaatagtttagtaatctttagaaaaataaagaaaagattgaacgatttaattgcataaaataaaaaatttctatagagcaaaataaatcataaaactaaaagataaatactactgtgaaataaaaaaacttttaaacatatgagagaaatggttaatatcattaatgttaactctagggtgggagtaaagttgggagctaaataaatactttggtaaggagaggaagagccttaaactctgtccatcaactccttcctgcagatatcggctccctgcacccgcaccaggtcaggctacttccaggtgggcaggctgggccaggttcctaagtacctagagctgaaagccccacgtacaccactcctccatcctggtggcccacctggaccctcctgcccctcctctgcaccaggtgtgatgataggggacaggaggagtcacaggagacctcttctctcagaaagcaagaccaggctgacatccaagctaaaggcaggggctaggactgctgggtggagggatggagtgggttctgggtcaaaggataggtgggaggagatggaaggctgtgcgcagcagcagggaggggcggtgaggagggggaaaagcagagatgggagcccaagcagctagaatgggggcggcagtcaagggcaggagaggtgggacagctgaggtggggggtgtccctccaggccccagagctgccacttcgcctctcccagtcatccaatttgcaacgagttccctttagtacatggaaagtatcctccggaacttgtttgcaggaaacaacgcaatgcatgaaagcccactttgagatgttaattacctatttggttcatttattcaaaatttttttttatttactctgagtcacactgtgctaggcactgggaacagttggaatactcaccacacccattcatttataaattttaagacaatgtgaaaatgcttagatttaaaatggaaaaccataaatgacaaggtttctctgccaagtctactcaactgcctttcaccaaggtcagagaactccagggtgtgggtttcctcctaaatttactgaggctgccatgggccaggcagcacgctggtctctggggttagagtactgactatcctcatgcgtttattaatttaaaatgaggcccaaacacagggtcacacagtgtccaaaatgaaataacctttggaccgacacagcttgtttcaaaacagctgagatccgttgcctttttggcatttgatttttggtgctgggccaaaaaaaaaaaaaaaaaaaaaaaaaaaaaaacccaaaaaaacggggaggtgtatctaggaggggatcataaatgcagctatttaatctgctgtcactttgtaagagccccattgaatttttgatgggaaaaatgtttttgcccgggttgagcttcaggacaaagaagaaatgcaaggaacagagagcagaattgatagtgtttaaaaatatgttaaaagatcttatactttgtaacaaagttggtaagctacaatggaagaattcctgacacagcagaggcctggccaaacccctcccctgggggccccgggaataaaagcttcctcctccaagctgtcagttgaaagaaatcgtcctgcctgatggccatgtgccactctctcgatgcttgggaacaaaattgtgatgttgcagactatacattgtttttccagaataacacagaaatgtgttctggagaatcagtttagacttagggtatttggtgaaccagtacaggactgggaaacagatgccctgggttctagtcccggcttcacaggagtgaccctgcccaaggctcgctcactctctctcaacctgtttgctcctctgtaaaagagggataatgagctaaaggagctccatctcccaagactaagtgaggatcaaatatagcaatcagtgggtgagagagccactcatgcttttctcctccctccctatatacacatcgtctccatgttccagttagaatctcaggcaaggccaagaactgaattcagggtggctgctcatgtccttggccactggcacaaatgtgtgcctcgaggccccactttcctcttgtttctgtcacttcttatgtcagtgcacccaaaatctctgctggcctttccatggtgtaaaattgttttgaggaggcatctttccagtctagcactacatttcctcgcctgccttgcatctggggttagctatatgagaagttctcatcaagggaaggtgagcagaagtgatgtgtctcctctgggctggggtttatgtgaagcagggggatggtggagccagtgatagaggaagcctggatccctgaatcaccacatggaggaaagctgtcagcaaacaaggaactggacttttcagtgaactggagtcatcagtgagcaggaaacagacttctgagattaagccagtgaaattcggagcttacttgttgcagtagctaatgttacccagaagatacacactatccacacactcacctcccctggcacaagctgccctttcaaacctctcagacattcaccgatcacattcacacagatccagggaactggatcactgatgttatcaacttagtcattgattgaacaaatatttataactcatctgcaatgtgcaaggagcaaggctaagcatccccaacacagtgcagatcacacccctacccttcctggaggaagtcatgtccaggcctcctcccaagtctagctgctggcctgaggcctgaggccctcattctcctacctggggatccagcccacccttagacccctgatcctggactttcccttcttcaaacaccagcccctactcactgtggacaatacaccctagagcagtggtttccaacccctaggcccatggacctccaccggtctgtagcctgttaggaactgggccgcacagcaggaggtgaatggcaggcaagtgagaattaccacccgagctccacctcctatcagatcagcggcagtatcagattctcataggagcacgaaccctattgtgaactgctcatgtgagggatctgggttgcactctccttataagaatctaatgcctgatgatcagaggtggaacagttccattcctaaaccatccttctcccgtaccaccggtccgtgggaaaattgtcttccacaaaaccggtccctggtgcctaaaaggttggagaccactgccctagagactgtcttccccttaggactgtcactccccgtcattaatgtaaaaatccaactggaagtcctcaccattccaccctcagccctctcagctttcctccaactgcatcccttagagacctccaaaaccagaactccctccttttatcattatctgtcccccttctgccttcccttcactcttaatctaggatcgacctgagagctgagcattttcactgtgtcttcaagccctgtacagatggcagggtgcatgtccagccatccctggcagccccagaagctgctaatagttctccagggccttctcatttgtcctgattcttttgcatggcctcccttcagatgtagtgcctccttcccccataccacacacatattgcgtggagctgaggacaccactgtccacccctggaaatggaaacataagctactgacccctttgcaagctgaccttgctgcctctttaagtgaagggtttaactgtgtccacagggtttggccagcagaccataggctggatttcaacttcattcacttcctttacacagtacacaacctatacaactgtacatggtcgacttggctttgagctcctaaatctggctcttggggtcctccctctggcttgcccctccagctgtatccaggccctttctgccatgccctggattctccaccaatagacagcttcatggggagccctgtgtatagcaggctacttcaaaccaccctgtctttgctcttactgtgtcttctgactaaagaattctgctttgctcagccggctcctggtcatctctgagacctcgtttgggagtgtccccatcctggaagtctttctgcatcccttcttgcctcctgcagcctccactcccagcccctgtggcccctgggtaacccccattggcactccttgccctccactgccatttctgtccacacatctgtctgaacacagcctctctccagcagggatcacatctgtaaacttggtagcctgctccagttctggacctggcagcagaggacagcaggaaatggaactaaatgaggaaaatggttttaatctaaaagagtgcttgataggatgaaatgaatccattctgatagattcactcattcatgattcactgggtcaacaaatactttttgagcacacgctgtgtgccaggcactgtgttggccctggggcaccgtgaacaaccatttctggctatgtgggagctcccagcttcagctctcacatacatcatggtaccagaaagagaagtgtaaataatgattctgactggggcaatgtgagaggaaaggaaaatccgggcctaacctggcaggggctgtgggtggaagcccatgattctgggagtggaaggagggccacaggctgcagccaaggcctgggggctgttccccatccacctgtgaccttcaagagcctaggcctggaagttaagatcctggactcccaggcgcctctcttatgtgagcggctcagagagcttgagcaaggcactgccctgctttacattgcaactttgagggagaagaatccgtggctgaatgaagtttgagcccccaggtctgatgtcagtccatggggggcctgcccttggtataagccccttgctcttgggtacagaggccaccacagagccagagacagccaggaccactttgtgggccaggcccaggctgcttgctaaaatttgaagaaccatctgcttacccagtgctgctagagttgccattttaataaccaagtttaggagattcagttaagattgggagcctcatccctctcctagggaggcctcacaattggtgtttttctttgcaaaagcacgagtggggccctttgcaggggtttttgtacagcaagcagcacagagagaaaaagaaataaaaccaacaactttagttcaaagatgccagtaatagggggtttcttttccagtctccccatggaaggttgtcgacagtacaggcacaatcaggcccggcggctggcctgctcagagagagggacgtgtgctcctttgttaggacgggctgaataggatgtccctgcacccagacctggtctcccggctaacaaagggcccctttatcaccccgggcaaagagtgctgctgaggttgccacagcaactcagggacacagacttaacgtgcaagtgacatttcagatggtaaccgggcatgcaaaaattcaaatttctttttgtagagtggtttccttctctagatattttaaaggaaccatattgcaaacaaaagaaaaaaataagtaagccaacaatacacacgcggtcaagcagcaaacagaacactgcaattcagcatgctggctcctcccctcctgatgaaaaagttgggtgaaaagccttgctgagggcatcgtgggaggccctgggtgagctgagggtttttcttatctcaaaggcaatcggacaacattaaataaagtttggggaaaaaatcacctggaattccagtcactggacacaggacacttttccttgtctctgtctctgtgtttaccaaatactactggatgattcgctgcatgccaggctgagagctgggccggggcatgcaaacagatgtcaggttcctgctgtccaaggtggacggtagggtgcggtctcatgtaaatgtgatctccatccaacgctacattgcctttagttgaggtcaagggagtcgcccctcagaggaagaaatcgatgtggcatgagcagaggtgagcagggaatagtggaacttggatttgctgccaacccagtgttgaccctttgttgctattcgctggatgggatgagggagaccctgagggaaggaaggaagacaaggaggaagggctacctctacattcttctatagtggaaatcatggtaaatagcatgacgcagacacaaatgtttacccaactgccaccataacacacgaggtattttccctccacattttatgatgacagtttaataaacaatgtggaaaggctatgacagcaaacacctgtgtatccaccacctggattccaccattactttcctctcctgcttttatcacatacttactatccatctatctgtttctctatccattcatcaagctgccttcttttggaagtgcatttccagttgcagacatcctttcacttcccctaaactacatcagcatgtgtaccatcaattagagtctaatacttgtttacaatttttaaaatgtgaaatttacatacaatgcaatgtacaaaccttaaatgtacattttctgagttttgaggaatgtgactgcctgtgtaacctaagccttcatcgagatataggatattagggttacttcagaaagtttcctcatgttcctgccggtcaattcccccacttaccaaccattagagcaaaaataacgttcttgtgttgctttctagtcttcatggccattcattcttctgtttacttaatcaattcattctttagtcacccagggcctgtgtctcatgtgtctcaggcactggacacatgtcccgataggagatggtgtgtaaatgtaaatgctctgggtttgaatctcaggcctagtgttttgtagggcaagccatctaacctctttgagctccactttcctgacctgtaaactggggatggtaacattagcaacaacctcacagtgggtagattatgtgagatgatacatgccaaccacttagtacatagtaagtgctcagtaaacatattgtcttgagggaggccacagctgaatggttgttgtcagccctccaggactttaaaagcctttatttttctcatggccattaactcgactactgtctctgtctaattttggctattaaaagccctgcttctctgaacgtttttgggcaaggatatttaggcttctacagaacgatcgtccaaagcccagtagagacttggaagggagtgaccagagagtagtacatcttttatttttatgttcttgtcttcatgcgccccttaaagtgggcttgcttatgaagccaccagcggttggggaatggtcgttaccataaggggcattgccaaaggtcttcttcaaggtgagaagtagcagctgactctatctttattctccttcgtccacccctgtgctatagcagatgatagaaaatacagcagcagaggggcatgtaggaccaaagtggagtattgtcatccttagaagggggaaacattagtagacattctcttgtgaaaatgaaggagccagggtccgggcaggtcacccttgctcagagctgagccacttgaagatgagtccaaaagcaaggataagaaacagccatctgtttcacttgcctaactcttagccatcctacagtgcccagctcagcatcacccccctcaggaagtactcctctgtgttcccaatccactttgtacttaactctattatgtttatcatactatacttcattgaccacttacctgtctgtctccccaattcagctatgagcacaaatcatgtcgcaatcatagtttgagtctctagtccctggcatgtgctaaaaaatatttttcttatattaatttaaccaatattgccaaatgttttctaagtactaggtgctttatgtgtattatctttgtttgtttgcaaaaatgttaatttttcttcccagttactataaaaaatttggagaatatagaaaatagaaatatagaataaaaatgtagtttaatgacagacaaactttaagtatgattgattaagaaaataagagaaagagcatatgtaacagatacaagagcatttcaaaaatcataatactaaagacacgtttaacccaatacatttgaaaagctaagtgaaatgaacaatgttgtagaaaagcataccaacatttactaagaaaaaatgatatgatcatccaattataatttaagaagttgaatcggttattaaaattcttctttcccattcattaggctaaaccagtataaccttgacacataaagcttggcaacaatagcacagaattttagaccaattttggttattaacatagatgcaaaaaaaaaccctaagtgaaataacttcaaatggagtttagcagtgtattagaaaataaaatatggctggaggtagtggctcatggctgtaataccagtcacatgggaggctgaggcagaaggatcacttgagcccaggagttcgaggctgcagtgagctatgatcacaccactggactccagcctgggtgacagagtgagaccctgtttgtaataataataataaaattagaagcaaatagaagtcccaacaattacccaaggtattcaaggatggttcaatataaataatatctctatatataatacatataattaataggttagatgataaaacccagatggttatttcaatagatgccaaaaaaaaaccacattgtaaactacaattaattcatgccagaaaaaaatatcttagcagactaggaataaaaagaaactttattaattgataaaatgtattaccaaaagctacagtaagtatcttacttaatggcttaatggtgaaatataagaagtaggttcactgaagtaaggaacatgacaagaatgcctggtatcaccacttctatttaacattgattctagaggtgctggacaatgcaataagaaaagacaaagaaagaagtggtaagaagattgaaaaggaagaacagaatcaatcccccttccagacaacatgaccatctacacagaaagtcaaagggaatctatagaaaaacagagcaaataagagagtttaaaaatttttcttgaatacaatatcaactttgaaaactttaatagtttcctatctatctgaattaaaacaacttttaataaaaaatttaattctccccaagttaattgaacaattaaatgtaatttcaagtaaaatactaatagggttttctttttaccttaacctgaaatttgtatgacagatcagaaagatgcagtgaggtgtagtagttatgagtgtgaatttggaagccaaactggctagttgcacatcctggctacagcttgttctaatggcaggtaagttacttggcctctctgtgcctcagtttcctcaagtataagatagggactacctacctcatgggattgttggctaagggagttgagcagagtccaggacttgcattcagagtctttgacctctcatctggtattcttatatgcaagggccagagtaagtcactttgtgccaaagtctgtcacacacgtgttggtccattagatcttttgtccagcagacactttgagtacaaattgtgggcttctttggctcattgtcagaaataatggacaggttggcatgctgttggccagagggcaccatggcaagggctctaggaatgcccactgctgcctcagacaacagctacccaccaacaaagttcctggaggagatgtgtatagcttgtacctgcctgcctctctttgcttatgggctttctctggttgccacagccctgtggtgcctctcaggctgaactgccaggaatgaatgccccagacaggaggctttaaccaagagtgttaagagagtgggtgggtaaaaccccaattccttgttctttaaggggataactccaagtatgcgctctacgctgtttccagaattccccagtggagttaggctccagttgcccacagtaggaatttgttagataatatgccctttcttgactgtcttcctttcttgtctcactttcccacaccactatctgtgtgtcccggaactgcgctcccgtaaactacttgcaccagaatctgtgtctcaggatctgcttttgacctcaactaagataagttgagcttttgaagtgaggttttccctgtggacttccattttctgcacctcaatccagcttaacatatcccaccacaggcatgctggctactgggaaggaggggacagagatagatggtagacagggcctcactggagggctgaattgtgacttccctcactggcaaacatggcccatctgtgagctggaatctgaacaattaaattcttcacgtgtgtgtgtgtgtgtgtgtgtgtgtgtaggaaggtgtgtgtgtgtgtgtgtgtgtgtatgtatgtaggaaggtcttctccccagaggtgggcaggaagcatccaggctttgttagcccctgtgctagtcactggtggcactgagatgagcgagctattgtcctcgccttggagaaactcactgggcaaatgtgatgttgcagttctttgagattcacactagtagtcctgtgtgcagatggttattggagcagcaaattggagcactaagttggagtcttggagaagtcttaaccaaataaatgttacttgaattaggtcttaaaaaatgagtcgacatttgttaggatttttatggctcggagaataggattaaatattttctcaggcccttaaaacttccacctggaagtgacacacaccgattctgttcatgttccattagctaaagtgtcacatggtcacaccgaaattcaagtgggtgggggagtacaagtctaccacgtgcctataaggagaaagaggaagaagattcattactagatctaagtgctcccacagttgggtatttagttcctctgccatagttgttttttagggattagtccttttgatttaaagccaagacatttcctaggtaaaggagcaatagatggagtaggactcatttccctcttggatcccatgggtaagtggacacatcttgtattaaccatgtctttttttttttttttttttttttttttgagacggagtctcactctttcgcccaagctggactgcagtggcgctatcccggctcactgcaagctccgcctcttgggttcacgccattctcctgcctcagcctcccgagtagctgggactacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaaccatgtcttattttctgtattctgatactttgacatctggggtcttgcagaccctggagggactgccccttctagagttagccaatacctagaaatagtcaacaactcacctgtgagcctgttagcataattttctaatgcaaaccaatacagagcctacgcctccaaccacctgtattattgggctctcacactccaactcactatctacctgctctaattactccagagccagtaccagacaactagggacagcccctatgccccagagctgctgaaattattcgaacaagccaatcctaaacctgctgacccggccttgtctgctccttcctgcggaagccacagtaaaggctcttgcccacagttctcccctctccctctgcctcctgactgacctggtgcttccccactggcccccaatggcatggtatgtcccctcctcctgacacctgggagtaccaaactgtcttttccatggcaatcatctcctggtgtgttgtccttaccatacctcaaggttaataaaacatattaaaacccatctatattctgatatctcagctatttatgatgtcagaaactgagaggtggaagatgaacaaacagatactctgggtctccagactggaccagctgggctactggctgagatctgagcttcctctctcacagatttttccttgcaatcaaagggaagagaggagaactgaagccccactaccatcttcaagacaacagatgaggctctggtgtttctttgggggaactgagtcatcagcttcctgtctgatcaactgccaacatgaagtggcaagatcaagctttggggccttgttggactttgctgctggacttctcagatacctccgtggtgctggctccctcctcagggaagaaagtggatatacgtgattggcagggttgattgttgctgctgctggcaggctccagagaagtcaaatagctgcctgtagctgacccattgcacatgcatcttcaaactctggtggtcattgttctacacctctggccagagttagtgggaccaacactgtggaaatatgggcagtaggaagtgctccaggtggaatttccagacttaggtgtagtcctggctctactattaactgtcaggatgtgcattcctcactgggtctcactcttctcatctgtaaaatggccacagcagtcttatttcctgacccagagtatttctgtgaagactgatttcttcaacctgcaacagaggtgtctgcaaaaaaaaactggatcacaaggtcaggagatcaagaccatcctggccaacatggtaaaaccctgtctctactaaaaatacaaaaattagctgggcatggtggcacacacccgtaatcccagctactcaggaggctgaggcaggagaatcgcttgaaccagggagtcggagtttgcagtgagccaagatcacaccactgcactccagcctggtgacagagtgagactctgtctcaaaaaacaaacaaacaaacaaaaacaccaaagcaaaatgaaacaaaaataaaactacagcaagcattataactaatggtgaactattgatatctttccttctgagatcaggaaatcaggaatggggcaagagtgtctgctactattacttctttccaaaattatactggtgatattagccagtgcaacaaggcaagaaaaagaaacaaaacttataagaattgaaaagaaaaaactaaaactctcatttttacagatgagatagaaatttttttttaaagccaaagaatctacagatgaattactagaattaataaatgagtttggcaatgttgctggatacaagggcattatttaaaaatctatttatactatgtttcagacctatattgctaagtaacaaatcactccaaaactttgtggcttaaaataacaataatcatttattatctctcatggtttctgtgcattttggattcaagaagggctcatctgcacagttcagcctttttcatgtgggtacagtcagatagcagatggaacaggaacagcaggagctggcagagctggggactggctaggaatccctctttacttagtatcagggtctctgcatatgatttttctgtgtgggttagtttgggcttcttcaatgcatggcagcctaagagagagttctcatatgatggcttagtgttccaaagacaaaagtcctgagagagggagccaggtagaagccctattaattttatgatctagctagcctcagaagtcacatagattcacttctgtcacattctttttgttaaaacccattcgctaagactaatcccttcccgaggggaagagtgttagactctacttcttgggaaaggtgtcaaagaatttgtggacatgttgtaaaacaacaaccctgtactgacaacaaacagaaaataaaataaagaagccattcataatagcaacaaaaaacacccggggctaaatttaataaaagatgtgcaaggtctccacgtagaaaactacaaaacattgctgagataacttttttaaaaacccaaaataaatgaagggacataccatgttcatggataagaagttttactattgaaaatgttaattttattccaattgatctaaaggttcaaagtgataccaattgaaatcccagcaagattgtgttagtgtgtttgtgtgtatatatataaataggtatgctgattccaaaatttctgtgaaagtgtaaacatcaagaatagccaatgcagtcttaaaagaacaaaatgggtaggcttatttcatgggacatttagacttataagcccacagtaatccagacattgtgataatggcacagggagagaaaaataggctaacagaacagaatagagaattcaggaacagtcttatgcacatatcgactacttgatttacgacaatgttagcattgcagaagagtatgtgtgtgtgtgtaggggggtggtggtggtggtggtgatcttttcaataaagagtgctggtcagttggatatccagatgaaaaaaatggacacaggacaatggaaatttttttctgatgaggtgtggcattgtatttctagaaacaatgactgctgaaatttatttggaagttctttcctttctgagctataatttccctctgttgttcccaagccttcagtgaatgcctgtttcccacacctatcttttgttaatgcatctttcttatggtcctagttctaggccaggaccagcaaagcccaagcagcagttgagaactaagttctaagctagctcctgagtgggcaggaagctcaagtccttttctcccaatggcatcctatatcctggtgccacacaagaatgccattctggctgacttcgcctcctggcctctcccagtcagacatacctggagcagtcagtgagcagtgagattgctaggggagattgctagtgtagacaattcttgcatgaaaagggggatgggggtgcaacagtctagcaaccagcaagtgatatcaagaactagagggttttttttttttttttggttggggaggaaccccatttcacagtcacctttctgacccaccatcagagccatcccattccaatctcattttcttcctttcctcactccaagagaccgtgactgtgggcagatcctagacccctcttcagagcttcgggctctaggcattcctgcggccctcccctccctatcattaaaaggggtggggtcctgctgccttctccaagtggtttcagctctggatcctttgggggcaacggagcccacccgcctggagctccattactgatgctgcaagtttttgactcagtttccccatatgtgagtgagagtttaagcgcggcaatctccagggggggctgtcaagctgactcagatcagtgagacgaggagggggcgggcatgctaagagcatcctccggcgctggcctgcgtccccccaggtaaggcagcacccatctccaaagtggtcctgtcaccaccttcctcttccccccgcacccacgccgcggggcggggactagcgccgcctcaaatatttagggcaagggagtgtcccacttctggggaggggtgccgttcgggcttctctcctcaccgtgggtggcgaaaggcgggacggaaaagcgccgtctggacaggcgcgcccccctcagggatgcagggccgggcgggggacccggcggcggcccagcccggaggaaggacctccacgccccggcccgggcccccgggcccccggccctaggcagcgcccgaggccggaacaatagcgcgcgcgggcggggcgggggcgggggcggggcgctcctctgggcaccgcccccggcccgccccccgcgctcgcagtcccgctcgcacactggctcccacccgccgcccgcccaggcactgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgccgggcgcattcccagtgatggaggcttgcgtgcctggaaccccgaacccgaggcgtcaggtcccactgccgggtctggcccagcctggatgggttgggtgcctctaagcagtccgcgtccccttcggtcgccggagagggaactttcaaacttagttaggaagccagactgtccgcgcgtccgccagtcggtgcgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggccccaggggagcggcttctggcaaagcctccctgcagttcgccaggggcagcaagcatccaggccactagggcctgcgcgatgtggggcggtggtgggcgacaagtgaggtctcgcgaagagtggcggtggttctcttttgtccagtgacctgcaaagttagaagccgatgaggggggatggtagcctcaggagaaggccgggagctgcctccagtctgatggaggaaaatagattaaaagtagcaagtggagttttcagggaggagaaggttgggtgtgggggcagctggtctgtcttctgcccttggctttgttatttttcaaaatgtgaagttggcgaggtaggtaccagcctctggtttgcgggtgtgggtgggctgggcatttgtgcctcaaagtctgagtgggtgggggtttagcctggagcgctccgtttgagggtggtgtttctataaatctcgccagggtggggctgtcccaaataggggcctttggaggcaggactcagccgaggcccctgctttattctgatgctctgtaaacctctgactcagcaccagaacctgtgcgaatctcgccgggaagggcccgtcagggagggaatgagaagccggcgattctggtttctttctgtgtgggatgtaggacccctggcccatagctgaggatgtgtccagagtggggcggggcagggatgggggtggggatgcagctgagccacttgataggtgaaaggaaggtctgactttgcacttggatgtgaaatctgctactcagtccttcaggctagagcagggtgaggcgggaggggagaggtcactgtattcatttaggggctagaggtcttttggtaagggattcccaagtgggcatggccttagtggtggtggttggggggtagggccaggctgtgatcaggaactccccttttctggctcaagaagtggatggggaggggttggggagggaaatgcccaagctccacctttacactagtcactatcaaagctggaggggaaacaggctcagggtgcagtagtgaccacacttggggcctgtaggcctggctgaatccagacattgtggggtggacacacccacacatggggggctctgtccgcagacaagaggctcgttgcacagggagccaggctttatatacataagggcaagcatttgcccaagtgatgcccgacacctatggggcagttgacctggaagggctcttggcgaccgtccccttggcgaccatccccttggcgactgtccccttagcgatcctctacacagagattcccagcctctttaaaccaaagtcacgaacattggttgttcttttggtatcttttgtttgagaaaatgcacactaatgaaaagctgttatggttttatttttgctttgaaatagatgtgtattttattaaacacaatattagcatgcattagaaaaatagcttaacaggtatgaagaagactcattactatttaatgtaataaaggtgctttttgagcatagggatttgtggccccatggctcccaggatctgtggctccatgctgggaaccattggtctcctccttctttgcattacagaaggggaaactgagtcacagaggagtgtaactcacagattacacagcaagtaaggaacaaagatgaggcctgagcccaggtttgactcccagcaggacacttgtttggcttttttgcaagtctctgtcatggttcaggggtttagagcctgtaacatctttcttagggtaactatgaactcctggttcagattttggcaaggcatcttaccaggctgggggacagctgggggatccctgctcaactatggcagactagtgtaaactagccatcagaactgggcaagcctgggttcaaatgtccatttgttgcttagtgacctagggcaaatgatttttagctcattttttactgagatgtgatttacatacaataacatgaagattttaagtgtacagttccatgagttttgataaatattaacactcatgtaaccagcatcccagtccagatagagaacatttccgtcatcccaggaagttccctcacatccctttatagacagcacgccttatccccacctccagaggcaactacttacctgatttctgttaccaatgctttctttaagttcaatttaggtatattaaccatgcttaagttctagaacttgatatgcagcataaacatttgtgtgtctgtcttctttttgctcaatgtaatgtcttcaacattcatccacgatgttgtatatatccatagtttgttccatttaattgctgagtaatattatattgtataaatataatacaattggtttatccattcacctgcaggtggacatttgggtttgtttccaagttggagctattataagtaaagctactgtgaacattcttatacaagtctttttgtgggcggggaaaatcatttaatatctctgagtcttggtgttctctcaaagacaacattgcctacctctgagtttcaggacggttaagtgaggtgatacaggttaggacagttattggcacataccagctactaattagataacaacaatatcaaccatctggggcccattccaggaagaggcttagcatctccgttccagcatccttcgtccctggactgaagggatgaaggccttcatcaaggccaacctgggtaccaccttccccatgtggtgcttcacagccagcaaacttctctttctttccaggcttccccaagaactgatactgcataggatgtggcatgttctgccatccatcattctaccaaaaatatttattgagcacttcttggtgctaggcactgtgcacagcaactgatgctgcagcagtgaacaaaagtcactcaaatcactgccctctggagcttatttatcagtgtgggaagtcataaatatatgggtgaaatatatggtatcatgattgatgggaatatgacttttggagaaaaatggaacaggaaagagagttgggagtcccaaggcctggggctggtttgtgattgttaaatagggaagttgaggaaggccttgtggtctagaatagtgtttctcaaatctatgtacacatgaagaatcagctggcaagattttttttaaattttattttaagttccaggatacatgtgcaggatgtgtatatttgttacataggtaaacgtctgccatggtggtttgctacacctatgaacccatcacctaggagttaagccccgcatgcattagctatttatcctgatgctctcactccctccctccccccggcacttgacaggccccggtgtgtgttgttcccctccctgtgtccatgtgttctcattgttcagctcccacttataagtgagaacatgcggtgtttggttttctgttcctatgttaatttgctgaggataatggcttccagctccatccatgccactgcaaaggacatgatcttgttcctttttatggctgcatagtattccatggtgtatgtgtaccacattctctttatccaggttaacactgatggacatttgggttgattccgtgtcttttgtctggcgagattgtaaaaacagattcttgggctccacccccagagattggattcagttggtctggcatggggtcctaggaatttgcatgtctaatgagctacccaggtgttgttactgctgatccaaggaccacactttgtgtagcagttgtttggttgtttgtgtacaggcttttgtgggctcctggcaggcaggaattctgcccagcacctggcatcgtgcctgactcataattgctcagtaaatatgtgctggtgggtgaaggattcaacttcccacccacacagctctgggcacagcatcttgtaaggatgagatctggacaagcttggttaatgaatgattgaggactctttttgacaaaaattcatgaagtggggttaaactatggacttgatctggacttgacctatgtgaggcctgcccggcatacttggtgggtgagattcccacagctcctttcttcaggggcacaggtggctgctaatgggtcccatggaaggtaccctgggatgggtgggcttagagctgagatggctggtcccagggaacgctagatggatgtctgcatctctgctaggaagctctcatttactttccatctaaacatgctccctatagctcctcccccaacctgtgctggaggctcctccaggaaggaccccaggatgtttgcatggcaggaccagcagcccaagcctggcactgctgcccccgatctgctgggtgaccttgagcctgtcagcacccttctttgggcctctgtttccctgtgtgcaaagggaaggcaaaccggtgaccatcagcctagagggatggtgtgggggtggaaatataatgaaataaaggctgggaatgtcatttctaactgtggagggtgcactgggagggaatgctggtgggaatggtgctttttgaggagatgggcctgctatccttcagaggacaggaaccactgtgtctgcctttacttttgtattcccagcgctagcctgacacatagatgctcagcaaatatttgctgaatgaatgaatgaatctagggcttggcagttgtaacctgtggcttgaggaacttagcatctgtttggctgttgtcatctgaagactttgtggggcacaaggagccagggcaggaccccgcagaggcacagagtctttggcggaccttccattcctagaggagcttccccaagtgggctcggaggacagagcctggcacacagagcagcctgtaggcgggaagaggagctgagcctgcatgaaggacaaggtcctgtgcctcccccttggtccagcagtccccctgctgtgtggctccttgccccatgtgattctgtagggcaatctattttgcttctctgatttcctagagttggtctcaggatatgaaggcatcatggattctggaacctggcagacttgggtttgaacactgccttcaccaccatcagggcaggcaagttatttaacctccctggactcagtctcctcatctgtaaaatggggacattgacatctcccctttggagcttgagggttggagaccatgtatgtgtagcacttggccccagcaggaaatgctttcattttcatccacaaagagcagcccaactgaaagttaaaatgcgagaggaacttgcttttctgtaccagctgctggaggatgctccacagctgccccgccatgttcttcttcttcttctttttttttttctagagacacagtcttgctctcttgcccaggatggagtgcagtggtacaatcatagctcagtgtagcctcaaactcctgggctcaaatgatccttctgctttggcctctcgaagcgctgggactgcaggcatgagccaccacttctggccctgggctgctggcagtcccaacgctggatgcttccatgtcttgatccctagacctgattttcctgagcctctgggttgaaggagcctcttattggagtgtccaggattatgaattgggagagagttgctcatttcctccaccttctgttaccttcttgaatctgtgcagcagagaaagtgggttttggaggcagagaaattggttcaaatcacagctgcccagtccactggcttgggcaggtgacctcatgcacatcacttagatgttcaggtctcagttttcttatctgtacaaggggacagaaatgcctgccttctattgttgctgcaaagatcagattaaagtaataggtatggaaattctgtctaatctagaatgatgtttcccagcctcggcgctattgacattttggacctaataacattgttgtgggagttgctgcatgcattgcggaatgtttagtcctatccctggcccctacctagtagatgccaagagcatcaccctgcccccagtcgtgacaacaaaaatgtctccagactttgcccctggttgagaaccagtgatgtgggaagaaagtttagcgcaggtaaactagaagatggtggtgaagcgaattgcagcaccacagcaggcaccgtgctttctggccagggcttcagtccactgtctcccttcagtaatcctgtatccacagggttgacagtcatcttatttacatggattcaaacctacaggatgatttttcagcatggtttgggagcaacagtaaaaacatatggtaagtgattattaacctaatgagttgtggtaaattgtaattttatatcttaatgaaatgatgttgtatgacacaggataatacattttgatcaatttccctgatatttaaaacttgctgccgtacagttgctaattctggtgcctgccaggatgagcaacctgattgtggtttttcaatatttaatggcctgtttactgctgggtttctcagatgttcaacaggtttttattgagtgcctactgggtgctggggattcagccctgtcctggaggctcagtaactccagaggaaagttttatttactgggtgaatggctatgtggatttgtaatcaattggcttaaaatgcagagtaataattaaatataaaattggctgagcagtgccaatgccgggagtgtgggaaggtttcacaatggcagtcttacaggaatgccaggtgggctgcctgggggcatgtagagtggtggggggtgttccaggcagagggagcagccattgtaggggtgctttggggatactgtcagcctaaggaggggaaacctgcctgcgtgggagttgggacaccagcagagatggttatgaagagccttgcaccccagcctgtggggctttaagtagaggactgtgcctggaaccaggggtacggtgcacaagtatggaatgcatcacattgctggattctgaccatcctcaacgactgtctcttggtcttctgctgatgggaaagtctaatgacttgcatttgatttcccccagtagcccatgatagatactctgcttctcaaactttagcccaccagaatcacctggagcacagttaaaacagactgctgtgttccactcccagaagttctgactcagcaggcctggggaggagctgaaagttagcactactagcaagtcgatggtgctgatggtgccagtctgggatccacacttagagaacctctggtctagactagaacgtggcaggattgtcctgccttaactgaggacagtagagatgtattgctggcctggggcatggagccccggtgtggacatggttaggtgtccttctcaagccccttggtgggttgtggggagagtcttcttcaccatggggaaagtctcacattgggttgcctggaaaaggactctgagatggagagttgctcgtggaaggtttatgtggggaagttctctgcggtgaggtgggcggaaggggtgcacctgcaggggacacaggaggaaacgtgcttgggccggggagaagctggcctggcctgacctgtggttctgaagaacgccatcccacagggagctgtggcgctaaggtggctctttagtgttgccccagatggaggtgaggggactgcccaagcctttgatttctgcatcatctggtcatttcagcataagtgagaggcctaaaaatgaacagcaggcagttcccttgggtgaaggagttcactgcagtagagggcagtcccattgaagggcgagctgcaagcccagccgctgatattcctgaggttgggggatgagcatatggaagagggctggagagtaccactgtgaccatctcagggagatttcccaggaaatcaagggccagcatgtggatgacttttagtgatggtcactcacttgctcaaggttcttctttgtctcatgaagtgagagagatgtgtcatctgctctgcgtaggaaaggcaggatagttactttttgggtccaagggaagacaaatggtaattaatggagtttttaggggctcaaagatgctcttagatgctccagggtgggattccagagtccttgcactgagctgtcacatatcttcctgtgtgttagggaggactccagatgggtctccaaggagcttctgggccatgcttaaggaggtcacctctgggcaagagccagggctttctctttgggctggagtcctgtctagttcaacaagaggccatctgccctgcccagcctcaatgcaggtcagtgtttctggctttgcctttcaccatcactgagctcccaggaagctcagaggcaaaggaggggtcacctgtagccataacataggctgctgtggtgtggctactgttcattaactcactcccaactgcacctcatttttctaccattttcctctttatcttgagtcctgccactgttttattttttaaaaattgattttgctctttgtaagacacacagaagtattttagaagaggaaagacacaagtgaagtccctctcactctctgtccctctcccttctccacacacagccctgtgtcccggggtgtccactgaaaagggagtggagggtgtacttcccatcaaaccctttcttcagttccttacttttaatacattcgttgtttttatttctggaatcatttttttattttcccagaattctgagtttcttgattgatctcatatcatcgtggtctattcttcttttatggatatgtgactatcttgaatctctttgaagatggtaattcgatttttaaaaaagtggtcttttgtttcctgcatttaactctgttttattggtgattcttctgttcacttttaggcctctcttttatgctgatattttctacaaatgcctggtgattctcggttgacatttaaatttgtaaatgggaggggggcatctagatctgttctgtggttgtgagtttcctcaacatgggtgaaagccgtgactgcgtgggtgggcagggtggatgttgagtagaaacgctctgtgtgtggtgtgtgagtgcagactctattgcggtgtgggatgagcctacgaagtccttgggggcctctttgtccctcgggtaggccagcagttacccccagggcgctggtgcactttttccagccttgtgctcacccgcaggagggagtctcccaggcagatttctcatttcaattagagaattcttctggttggcattagcctgggggcaaaaccaacaaacagcttctcccagggctttggacgggcacaggggtcccagcgcaggcttcctctctctgggaatgttctggggttcagttaggtgttgggtgccggttccttagtgctcacaggcttcgctgtcagtctgtttctttgacttcttagtttctagcagtctcataacgtttctgatcccagccttttcctattttcttatgtgccttaagttttcctaagaactatgctgggcacatttgtccccatttttttaggtgagaagactgaggtccagatgaatcaagtaacagaagggtggcagagggggctgttaggcagagctggaatttggcccgagcttgctctgcagctgtcagggtgccagggggagctcacttcctcctgctgcaggggtggaagagtgtatcactggctccttgtcctagagtgctttttacattacagctaattaaaatgtgcttatttcgaagctgggcctgatttgcaggaatgatttagaaacttgtcggaaatgaatcgactcagtagtagtataacccagggtcaatgccacgcatatattttattgtttcatcatgctgtgttttggcttgaactgaactttatgatgtggaagatggaccctgggccctttatgtctcatttattctgcaaatatttcctgtttacattatttaggaaggtctcccacccccactcccatgctttctctgttctctatgtccacctgagatggaagttcatttttatgcaaatccagatgttggatccaaatgtgactttgagtttgatggaagtgcctgggttcgtatcctgacacttataagctgtatgactttggacctgtcacttagcctctctgagtcgtggtttcctcacataatcacaattgcatctcaggttggtggttaggtctgtgggagagcaagtaagtcttcccctccctcatttcttcctccaggcactgtttaggtgaaccgagccctctgtagaacagcgagcatagaccctatactaggttttagtgcctttatacactgtacagtctaaggagcttttcagttcaggatcggtgtagcgcttgttcccattggggctgtctcttttctctcctgtatcagttcccttctttctcattgcaattcccacagggagtttttaaggaccaatgaaacattcagactcacaagatgaacacaggggacacttggcaccagtctcctcgaaagatttgggacacagcctgacacagcctgccagcaaggcacgtgagctgttctcttctgcacaagtaattcttgcaacagtctccgcagtggtccacgaaggtggccaggagctattctctttgctgccccctccctcccaggatctagttcaagtgcaaaggaatgagatacacaatgggtggctgtggaagccaccctggcttagaagccttattgtcccagctgccatatccattgtaacaattccgtaggcttagcttcaaggacccagggacatgtcaggtacaaatttctctgcatctaggaaaacccaaattatggcttctttttcagatatttataacttatttatagttcctcccagttcaaatgcaacttaccaatcaggggtcatttttaccataagcagagttgcctggtaacatagttaacgtcccactttcctcaggtttccaggggagttatgctccgcaattaacaaaggtgaaattctcttgcaacaaggaaaagggtttggttaaccctttcccccatattcatcatcctacttttttcccctgtgggctggtatttttggcatctcttttggaaggacgaatggagtcctcagaaatatattccacactgtgtacattttctgatgatctatataacacacacacacacacacacacacacacacacacacacacacacacacacacatcatgagatatgctttggagtcatactggcctgggatcaaatcttggctcttggctttgccacctatgaagagttaatttccttccttccttccttccttccttccttccttcctccttccttccttcctccccttcccttcccttccccttccttccttcctttcttccttccttcccttccccttccttcctttcttccttccttccttctttccttccatccttccttccttccctccttccttccctccctccctccctctttccctccctccctccctctatccctccttcatacagccatccaaggagcatgcactgcctgctgtatgcaaggctttgtggtaggtgccaggcaggaacaggtaattaagacatggtccttttccttgagaagcatgatcttattagagagacagaaataaacaatttcaaatgtgtgtggtaagcattatgttgaagtagcacaggggagtgtgggaccaccaggctaggctggggacagtcagaaaaggcttctcagaggaagggacacttgcctgtgcttgaaggtgagtagaacttggccaagtgaagaaggtagggaaaagcattccaggtagaaggaacaacatatgcaaaggcatagaaggtgctgagagtgtcaagatgtgaggctgaagaagggagccaggggcatttggaaagctgtttattatctctgacttcagttttctcgtatacaaaatgtgatgagcaatgcttacttgtttatgaaattaaatgaggtaatgatgtatgtttaagcacctggtgtagttagcttcaattccctttccaaatctgtctacagatgcctaagagccaggctttgattttaaatgagagaaggaataaaaagcactgaagggcctggccgcccacttgcacagtgcaggtttcctgcagctgctcttgtgttggtcgctttattgctgctttggacggagcactaaatgtctgcatgccgacctggattacgtccttcaggatcagcgaagcacatcattgtgttttcttaatggctcaatgctaacagcaagtcacggcctgtcgaggtgtcctgtgggacaatttttcatctgcctatggccatgcttctgtctgacgctctgtcaacacgccctgtcattcgcttctttgtcttgctttgccttccacatgccagctggggaaacttcgctttccatggagtttggagacatttactatccagtgaccaaaggtcaggatgagctgaggagccatggtggccaccatcaatgtctttatgatgcgtaaattggatcctgtctcttctccatacaaagctactcagtggggccgggcgtggtggctcacgcctgtaatcccagcactttgggaggcagaggcgggtggatcattcgaggtcaggagttcaagaccagcctggccaacatggtgaaaccctgtctctactaaaaatatgaaaaaaaaaaaaaaaaaacaacaacaaaaaaactgggcatggtggctcgtgcctgtaatctcaactacttgggaggctgaggcagaagaatcacttgaaccctggaggcagaggttgcagtgagctgagatcattccactgcactccaatctggcgacagagtgagaccctgtctcaaaaacaaacaaacaaacaaacaaacaaaaacagggaaaaaaacccccacaaagctgctcaatggctttctgttgtagcttgatgaactcttacaaacctaaatcacatcttcttaggtttctgcttaaagccttccagtgctttgccctggtgagtagataacatccaactcctttggcccataagtcctcacgtgagcttgcctctgcctgcatttccagcctctgttccaggaaccaggcttcatgctggggacatggtgatgagcaaagtcagagtcagtccccctcagtgactccattccagtcacctggccttcttgctatttctcagatccccccaccctgttcttttgcgcttgaggggctttgcacatgctgttccctttgcctggaatgttcttgccctcattctttacatggctggctcctgcccagcctctgacctcagcttcatcctcgtcttcccagagtctgacctgctcatctgtgcagttgtctttctttttgtctaccatagcctctgagtatttttattttttaattttttatttgtttctttatttttttgagatggagtctcgctctgttgcccaggttggagtgcagtggtgcgatctcagctcactgcaaccttcacctcccaggttcaagtgattctcctacctcagcctcccgagtagctgggattacaggaacacaccaccatgcccggctactttttgtatttttagtagagacggggtttcaccatgttggccaggatggtctcaatctcctgacatcatgatccacccgcctcggcctcccgaagcgctgggattacagacgtgagccaatgcgcccagctgcttctgagtatttttcttcgtggcatcatatatctgtgaaattacttggttgctcccccttcaggataataaactttaagaagcaataggctcatgcttattttgtttaccattgcatccccatggtgtctgacctatagtaggtgctcagtaaaaagttgttgaaagattgaatgaatgaatgaggcaggttatatttttcagagatgaccaccgtaacatagcccaggctgtgtttctaagaataatccactcaccctctctgggcctcacttaccctgtttatatgttgttgccaggaggattaaacacatatatgtgagggacacagtgtttggggcctgcaagtgttaatccatgtgaattctataattctccttgtagaaacatgccaggcccatctctagctgagtccaaggaggaaagttgagatatgactcaagagggatgatgtttgaaatccttgtcctcatggcttttaatcaatgcttgaccctttggggcaaggctggcagatgcagcccctgttttgtccccttcccatctccctgggaatgatgaccttgcctttgtcaggagggaggcgtcactcccagttgcttgggctggggtatctggggcacagttggcctggccttcggagataataaaatctctctccagcccatgggaatgtttctgttgagcaagcaggactttttggtggcttctctcctgaagttatcactcttcttttttaaaaaaattaaactgtaaattatgaacactatgttacctgccaaaaagtttaggaaatgagggaaatcacctgctatgatcccacggtgcagattcaagggcagtgtttgacactttgccttcttaatactcaaggcttgcaaactgcactgccctaccatggttttctggaagccccttacccatcgctttctttctacctattcctgatgtttattgtttatgtccttctctcctccctcctctatccccttcactagaatgtcggctttggaagtgtggggaatctctgtcgtttgctcatgggtggagccttcagagcgactctgactgccaggcctctggttttagtgtttcccacccaccaggcaaactcctacacatacatcttttatgttttttttctttaaaagacagaggcttgctctattgcccaggctggagtgtagtggtacaaacatggcttactgcagcctcgacctcctgggctcaagcgatcctcctgcctcagcctcctgagtagctgcgacttcaggcacaggccaccacacctgataatttttaaattttttgacaaggggtctcaccatgttgcccaggctggtctccaactcctgggctcaagcgatcctcccacctcggcctcccaagtagctgggactacaggcatgtgccaccacgcctcgctaaacatacacgtctgttaaatttctgctcaagcgccaccccctcctggaggctttcactgctatcctcccctgtgctcctgcccttcccatctggcatctctgacactgtgggctccctggggctgggctgcccaatgtccataggagacatgggcttcagaggccatgtctgggtgcttggacgttgacttaagagcagtgggagtcctggaggtgtgctgcgttttagaagaatctttgcagttgttctgtgggggaaaatactggacggggcaagagtggaggcaggagaatagttgggaggtggtgcctgtggctcaggggagaattgatgatggcttgtggccatgctatccagtaaggtagccagtagccgtgtgtggctcttttcattgaaaatacaggaaaataaaacaaaatttagttcattcacactagccatatttcgagtactcgctagccacatgtgggtattttagcccctattgggcagcgcagatacagacatttccatccctgcagaaagttctgttggtccactctggcttggactgtggtggtggagtggaaatgaagagaagtaagggcgtgggaggtaacaggagggaagatgtatgcagtttggggatgagttggatctggggtatggtggagagtggggtatcaaagaagactcaggaagtaaaatttctgggtcaaaaaagagtgagcatttttatggctcctgatttctgctgacctgtcattttccaaaagggtcatcaccactcaccagaagcatgagaaagtgcccattttatcctgccctcctggcacagcttattaccttcggaacacccttccattgtgtatatctcttgccaaatctgccttcatttagggtctagcatgtggaccctgaggtctttgtgatctcagggacttatatgtatattaatgcagatttcaataaaaagagttatgtttgccattgtggtacggtctgatgctgtttaaatgccttcggtaatatcttcaatcagacagcaaatagaaaacagggaagttagtaataaaaaatgaattaggacgattagcaaaaggtgaaccgcttccctcctcaggcgacaggcagagttgacggagctttgcagggtgcctcctgtccaaacacacgtctggattattgcagcctttggggctggccctggggtcttctctgcacataggacttggttattgcatttagttttgcaaaggtcatggacatcccctcggaggggctttgaggggctcacaccaggattgggggcccgcaccctgggttgggtgaaggcaaggggttggagaggggttgctgcccccccccgccatttctgactgagggcaggtcagcggcttcttcctctaagcagagacatcagtgggccttgcttccctccgtgcatcctccaggggcctggacaaatctcatctgcccctctttctaacaccttccccggggttgcttttggggaacatttcctggctgtctggtggcaggggcaaagtcccttcaagaaggaagtagaggcaaaggctataattgactaacgcagaccctggggcaccaaagagaaacagaattctagtgaccaagtaagttcactagagtttagagctcaacagaagggtgagaagcttctacctgggtaaagttgggcatcacactcacctggagcaaaggggaccacgttgacccccacaggtggtgaatgtctccgttacctagctcatttctgtagctgcaataccatcaggatttcaacatgtgaactttggggggaccacagcattcagaccatagcagataacatgcacattagcaatacgattgccatgacagagtggttggtgtggttaatacccaggttagttggctgatccccacagagggctggtgactgcctacctcaggccagcgcagctgaaactgaagagcacctgaatcacatgagggtcttgtgagaacgcagattctgattcagtaggtctggggcgggtccagagatctggcatttctaacaagggctagatgttgctgctcagggggccatgctttgagaatcaaggcgcttgtgttaggctgagattctagaagcagagcctgagacgagggttcttgtgcgagaggtttggtggggagtgattgcaggagaaagggggaaggccctggagcagggatgttacgagaaagcgggtcccacctggaggctggggtgttgcctctgcagcccacatgtcagttagtcattggccatgggctgcccaggacagggagaggtatcatgcctcctgtgccacctcccagcaggtatttctccagagggagcagctgtgggcagctgtgggcatcagcactcagcccccggggtgtgggtgcacagcctgaaagaggggttctgggtggaactcgtggtcatccagtcacagtatctttgcctgaggatggccttgaggagggtggactgggaggcaggactcgggctccgatgtggactctgctgtgtcccctggggtggccgcctctcctttctgggagctgcgtgtgctgcaggttcacaaggtgatggtttggttggtcctttgttctggtcctcaggctgtgatggaaggtgagggtggggatggggggagggtctgcacaggaagaggcagctcttatttcagagcccaaggtaaggagagagagagagagagagagagagagagagacctgccctcagtcagaaatggcagaaattaccactgaggcctgcagtgttcagggaggacttcctggcagagggaaactttaggtgggacctccaagaagcataggaggagaacatagaggaatggggaaaggcagaggcatttatttagcatccatcacaggatgggtatttcacttacgttatttatttaatcttcacaacaatcctatgtagaaagccacctccaccgtgcaggtgaggagctgaggcttgagaggtgagggcactgggccggggtcacagtgggattggaacccaagcctgcttgccaggaacatactttctcttcctaagggaccataccacatagggagggggtgtgtggaaaggggaggggagctggaggccttgggaattactgcagacctgactggatgggcagaggctcgtgtagagggggctgggaggacactgactaccaggctctggggtttggattctgtatggggagccatggagggctttggggcaggcgtgatggtgcagtgtcatgccctctgtcctgggaccctcttcccatcccaactctgagccagcttctccacattgtccaccctccctggattcagacttcatctgtgtgtgtgtttgtgtgtgtgtgtgtgtgtgtgtgtgtatgtgggggtgtgtgttggggtgggtggagtccatcctggaccctttctgtagaccattttttggacatttgggctactccagacaggggtcatctatttttgctgtaagtgttttgtggggcagaggccaggctaagctgccgacagcatccctggaatcatgctctgtccaggaatcttagtgacagctgggtgtctggccactgtggtgagccttccttctctacccttcccatgcagccagccccattctgtgcactggtgccttgggggtgaatggaggaaggagcacaaatcattatcccagatgaagacagattgggcttggggtgcgtcaggaccttgtggggaggattcggttctgaattattttcagtcttctttgctctgtccccacctctgtggcctgagttttctctcccagtcaaagctgggaacatccaactctttctccgccatcttccctgtaagcctctcctgcgtaggatgttatataagctatagtcacagcttggaacctggcacgatatgctgatatcaaacatggaaactgttagtgctaagctgctatgtggggataagatggtcgaatgaaaggtaccagtggagttggggcggggacgaggaggaactactgttcagtgaatacctactatgtgccaagcactgtgctaggtgtcttttgtgtactatcttatttaacccctacaacagccctgcaaattatgtattactattaaccatgtcacaaatgggatacctgaagctcagagaaacttgcccaaggtcacacagcctgtaagaagcagagtggatctgccgggtggggtggctcatgcttgtaatcccagcgctttgggaggccgaggtgggtggatcacctgaggtcaggagttcgagaccagcctggacaacatggtgaaaccctgtctctcctgaaaatacaaaaatttagctgggtgtggtggtgcatgcctgtaatcctagctactcaggaggctgaggcaggagaatcgcttgaacccaggaggaggaggttgcagtgagccaagatcatgccattgcactccagcctgggcaacaagagtgaaactccatcccaaaaaaaaaaaaaaaaaaaaaaaaagaagcagagtggatcgtgaacctgaatccgtctagctctgaagtcatggtctttattctgcaccacatattcttgcatgcacaggggtctttagcttccttttggagaccctttcatgtgttcctcattgagactcagaccatcaacctgagaagccttggcatggcgtcttgtcattcccactggtagagacaggcagacctacccacagaggtgagtgcccaccttgtcccagctcaaggcaatgtcataggccagcaggctcaaactcagggtctgaactttcctgatcccagctgcttcccagcccccaagaggctttgttgttttcaacttgatgttgagtagaccagacacatgttctttggctgtgagtattatcagcgcaaatgctcttatattagctcctgtattggttgtgtattgcttcacagtaagccaccagaattaatggcttaaaacaataaccatttcattaagctcatgattccatgggttggctgcaaggcttcctggctaggctggttgtctctacaggctctccctccctgcatcatggtcagttggccagtggcctgggagctgggtgatctaggacagcctccctcgtgcagctggcagtttgcatgctgctggctgggggctggctggttgttggctcagctccccacatgacctcctgtcctccagcaggctagctcgggcatgtgcacctggggctcccaggctccctggtgcatcaagagagagcaaaccccagtgtcctggtgcttttcaagcctctgcttgtgtcacctttgttgttgtcccatttgtcaaatacaagcatatggccaagcccatattcaaagcataaagagagagatgatgagaggagtggcagcctcacggtgccaagggcatgcatgcaggacaggaggctatgattaggattagtggtcatctttgtaatctacacagctgcccccactcttcagacagcagacattcatcgagtccctgctgtgtgccaggcactgtggcagggaacaagacaggccttgtgctgtgggcatgtggcctctagtctagccagtgaataatcacatgatgaaacataactaaagcagaacaggtgtgatgaaggagagccacacagggccgggagaccaggcaacagagagctctggggggactgtgggaagactaggagttgctagatgatgggcacgggggaagcattccaggcagggaagagcacgcgcgaaggtcctgtggaaggaggggcctggcacacttgaccactccaagaaagtgccagtttcttttaagtgtcggcaaccttgggctgggaaaggaacttctggttcgcaaaggtcccctgagcatttccgtgcgatgcagtctcaggagggaggtggctgataaccttcccacgggcagctcctgggttttgtgggctgggagaggagacccaggagggatttgagcattgggaagggtgttgtgggcacagagttcagtttgaggaagggggaggaggaagcaaggaaggggtcagttgcagaggatttgggagggactggtgtgtgagggaagtgaggggttttggactcagtcctgctggctggtggtctttgaaccatggactgagaatgaggtgatcagatgctggggaggcccgtagggagggtgcacagaggaatgacttggggaccctccccagccacaccccaggtctccaaccctaagccagcctctacgtccatgtgcagggctgggagggccatcctgggggcgaccgcagcatcgagtccccatgcggatctgcctgcccagtcccataagcagcctttgatgtccctggagccttcaacagcttctctgaaggcagatcaggggctgtggttttggaaaaggcctagcatcactgggtgccagaatcatgatcataaatgaaccagcacagattggaaaaatgggaggagtctggagtgtgggttccagcttcttgccaatgtctccatgaaaccgtgcaagtagctgcccagtcctgagcctccgttttctcacctggaaatagggccagctcccatcctccctgggtcaagtgaagaggaagctttgagggctgttaacctcagcaccttcagtctaatgcttgtggacaatgcgggcaccccagtgactgcacggtggagtgaagcaaactctcctcttaccaggacccatgtcagtggaactttcttccccagaataaatagaaaccatggcaaccgggatatgtcatgtggactggcagcctgtcccagtgatggccaggagaagggcctggcacagatgcgggccccactcacaactccacccgctgtgggatgacccaccgggaccccttagtcctcccctcctgcctgaggtaggactgagaagttcagtcctgaccttgggtttccattcaacctcagattttattattacttaatagtaaaatgcttgtcccggaaagcacgtctcaaatgagataagttgaagcaatcctggctcctgccccatgtcctgatgggtgcactaggagttatcaggatactgctggatgtgggcactgaaatggcagcaaatctactctgagagggagggcgctgagcctgtgagcgccttcagtcttcagatggccagcgaggtggtggcattaatatcccactttacggagagcctcagctctttacccgggattcacagctagtatttgacagagctggcattcgaacctgcatcttcatgccccaggacttatttccacactggctttagctgaactggaggcccagccaccacatggcaggcaaagagcatttgtcgctccctgcattgagggggtgactggtctgtgacgcctgcccccagcacaatgggtccaggggtggtagaggggcatctgaggcagctttgaaggccagggggtttttccagcccttgtgtttctgccttatggcctccttgtgcagctctggcaggagtggacaggtgccctcgcttctagaagcatggtcttgccttagctggaagttgagggtggagcttcctggagtcgctggcttcacctgcctctgcagccatccagacaggatgccaaagccccagcttgggtaacccccttgtctcttggagccccagtgtccttatctgtaaaacgaggagatcagtgactcagggacagcatagcatagtggtgctgtgcatgcacgttaggtcctaggaccttagttccaattctgtctgtgacaattactagctgtgcacatctagtaagttacttaacctctctatgcctcagtttcctcctctgtgaaatggggataataattgcatctacttaatttgtggtaaggtttgcatagggatttcatcatattgggactggaggagttgagtaagaagaaagggcaaaaccttggtctagcttccgccaatttctgggcaaaagctgaagttagcacaaagtcagcccaagcatgctccactgcactcaaagtacagttctgctgccagaacccagccagggggaggggatgggaactgtataagagtaggacggatgccaagactagtgaggcattttaacaacatgaggctggaatgtggcattgtgtaagtcccacaaatgaatatgtgcggtgaggttggaagataagcgagggttcatttggtgagaccattcgtatagtcagacatgagtttaaactgaccctgcagcttagaagctgtgtggcctcaagagcttacttaactcctctgagcctgttggcacacccaaaaagaaaaacaactcatttcattttgctagattgtctaaggattaaagagatgacagaaagtaccagtgcctggcacagagtagatgcttactaagcaccccaagagtgtcttatggggtgcttatgtgattcagtcggtgctgctgctgagtgaccacagggatatgctcagatatgctgcagaggtttccttctgtagttaaagggcagggagtcatgccctgtatgagacatttttccttagggaaaatgaagtcatgggacttgttcatctggatagtgcagtccaggggtgtatggggcttggggtactgcaggcaagtccctgggacagtgtggctgagggatggggcattgggtctaggagcttggtgcagagctcaatcaggaaccttgaaagaaaacacaatgtgaagactttctaccttgaggacagtggggccgtggaaggattttaaatggtgggacgtcactttttttttttgaagagttggtgtcctactctgtcacccagactgaagtgtagtggcatgattatagttcactgcagccttgaactcctgggctcaagtgatcctcctgcataaggctcctgagtagctgggattacaggcatgcgccaccatgcacagctagctttttttttttttgtctgtttttcagagataggtctcgatatgttgcccaggctgctcttgaattcctgatctcaagcaatcctcccatctcggcctcacaaattgctgggattacaggtgtgagcaatcgcacctggcaactttttttttttcccccaggaaaactctactaattggcctggaaaataaatgggggagggtgagctaaggggctgctatggggatccaggccagaagggtgagaggctgagccagagtcgcagggatggagggagaagaggtgactgcagaggatgaggcagctatcagggcaccctaggggtgtggtgtggcactttagtggtcagtgctttgcagagacgaggcacatgggattaagcaaacacaaaatcccagtgggcatgaggatgtagaccagggcaccttagaagcgcaaagcggctttagtcacttcccttgcgtgagatttgtttaatagaagcttgcagcttcgcagcacttaacaggtgctgacgggggcatcacaatattgtgaaattaagctgtgaagccgacttcattaccagcttacctggcgatgaagcagctgccttagttagcactgatggttgggcatgacagagctaaaattgaacttggcaattactgctcatgagaggttctcagtactgtgaaaggaaggttccatggaaatcaaccctggtaatcacagggtttaaaattagtcagttactattaaggttgctctgtcagcatatgcttcagggtgatgtgagggaagggggcgtggaagcttgggtttgggctgttgtgggttaccttatgttcacctgcactgcatttaagaaaaaaagttggttctaggacaaaggttcgagagtcccagggttaatatcatggtgcagggtggccatttggataataggtggttttaaagcctttttttttttttttgagtattttttgagacagaatttcgctcttgttgcccaggctggagtacaatggcgcgatctcggctcactgcaacctccgcctcccaggatcgagtgatgctcctgcctcagcctcctgagtagctgggatgacaggcatgtgccaccacacctggctaattttcgtatttttagtagagatggagtatcaccatgttagccaggctggtctcgaactcctgacgtcatgtgatccacccacttcggcctcccaaagtgttgggattacaggcgcgagccactgtacctggcctaaagccctgttctttttatttgcgtaagctcacaccctctcagctttggtgttttctattgacttaaggaggtttcctgactcgcttctggtctctccttgggatgttgcacaggaagagctcagctctctgtgggttcctccttgccctggaggaagcaatgatgtgataggatgggaggttcctgagtccttcacagaattgtttttggtaaaccttggctggaacatctcagcaatctcagaagatttgtccccgttttgtgaataaagacagcaaggggctgatatgggcttggttgctactgtagtgaaaatcaaaggacaaagcttataatgattcaattgtgagtttgcctgggctgtgtgcactgaccctcatcaataagaagatggaagttgactccttgctgtgagcctcaacttcctcatctgtaaaaggggaacttgttttgtgcaagtgtgaggattaaatgagatcatcaaagcacagtagaacctcagcatggtggctgttggctattaacagtgatatttatggaccagaccaggcactttccatcgatgacagctgctttgacaaaaaccccaccaggagggaactattattcccatcttaacattagtaaacagaggctcagagaggatctaagtttggccaagatctaagggtacagccaggattcaaacccaggcattctggccacagagcctggccattgtccctgcccctcaccctgggaacagctgaacaacaaggaaacaagtaacatcatagctcatgcctgtcatcccagcactttgggaggccaagacgggaggattgctttaggacaggagttagagaccagcctaggcaacatagtgagaccctatttttacaaaaaaagaaaaaacacaaaaattagcagggtgtggtggcacatgcctgtagtcccagctacttgggaggctgaagcaggaggatctctcgagcccaggaattcaaggctgcagtaagttatgctcatgccactgcactgcagcctgggcaatagagggagaccctgtctcaataaataaataaataagagaaaaaagaaaagaaaaaagaaaacaagcagcttggacaagctgcctccatggataagaagagagaagcattaaaactgaaagatcatttgcaaaaggctgcagcttctccacaggaagctgagtcatctctctttgttttgaaccgtaaccatcacgttgcctcagaatctgaaaaattaaaaaagaactaaaaaaatgctgagtttcttcatggtgcagaggcccttcttgtctccacaccagaaggagctgagcagaggggccacagcgatgggaccccctccaacccacattaaatacctccacctgaatatttattgcaacggcaagagcactgcacctggaatccggtctcacagccttggatttgccttgctaagcctcagtcatccaacctgccaggcaggtgcacctgccgcagccctgccttctctgtggagctggtgctctcggggtgcacgagtcagggttgggaggatgctttctcacctgtacacctgtggatggtacgatcacaaccccaaatgcctcctcccagtacatttggcagaattcagtccagaatctgggccttggcctagctcctataaactccctctcctacagatggtggggttcagtaagagtttgatgaagaatgcaggggctttctgtgcttgtctggtatcacccagcttctgccttttaaaatgcctcattccttatctgtgtactcaaactctgccccttctccaaatctcggcttgactgacacctttttcatgaggccctcgcccaggtgaccaccctgagacccttaccggtgagtactgtcttccttatactcacctctgtgtgtaagctgggcttcctgtgaggacaggggcagtgtcctgatcacacattgctccagcttctggaattatgacctatgtgaagtagggaggaggcagagggaacaacaaaaaaaaagttttttcagtgaatgaataaataaatgagacttgaaagatttttacctttgtgttttctctctgacaatcaattatacctttcacttatctcttgtttctgatgaacaagtttaacattcaacaagcaacatggcttcttgcaacatcaacaaatgcccatcattttcaaggccgcatagtattccattctatggagagccatgatttatccaatcctctatcgatggactttattgtcattttcatcttcttataaataatgatgcaataaatatccttgtccacacgaatttgagcctagaaagttctttatcatcctaagcttatataaatattcatggacaatttcctcttgcatgcttacagctttgtgtgtgtgtgtgtgtttctaaatctttggtatgtctgaaattttcatccatctttgtatcgcggtgcaaaatgcacctctcttttgccttgagacgagtgtcatgtgccttggatctatgggttgtgtgcactttctatctggtgagcacgcactgtgtgtcaggccccatgctgggagccaggacccagagatgagcaagacagacgatcctgaccatcaagaagctcagagcctagagaagaacaataaacacagaaacaaaagccatcaaacacatgaacagaaacgattggctgcaggagtgtgctatggacaaagtaactcaggtgcaggtgagattagaggagctctctttggggaagaaggagatctttgagcagagctggaaggatgagaagcagtcagttgtgtgaaggtcaggggaagagcattccaggcagagggaacagcatgaaaaaggtacagaggcagggaagcaagacttttttcctttctggagccttttgtaatcccccttccagcctctccctcctcctgcagacacgctgggcaccagccccctttatcacatgacatttgctattcccaggccgttctctctgtcacttactttagtattgttacaagtgttcaggaataggatgattccccagagcgcttcctgcttagtctggatcctctcagctctgtggtgcttcctcagcagcctttgctgctactgaaatgtccaaaaaattaaaattagtttaatagcacctggcatagtacatgacacttaataggtactattatccccattttacaggtgaagaaactgaggctcagggaagttagccattccagcaggcagagctaggattcgaacccagctctgtcttatttcaaagtctgccttcttcatggagccctagtttaactgcatttgtgcgaaagctaatgagagactgctggttaatccttagtgcccggggccagctttatcccaagcccgatcaaggcttgtggtgggtgaccttggcctttggcctgatggcttcagaagagtggaaaggaaccaggggaggttcttatttttttgttttaaattacaaatgtaatacacgcttgtggtaaagaaaaaaaaaatgaaacaagaaagaaaaaagcagccactgaaaatatctcctcctccctagtgtaactgctattaacagcctggtatcttttatagtgcatgttcaaacacatacatatacaccgttattgtttttataaaaatggaaccatgtccttgactttttcttgcaggcagttccaagtcagtacctacacaccttcctcattccatcagatgtatttcagtgtattcaaccagaccctggctttcgacatttagctgtctctaattctctctgtaacaagcaacatccttgggcatgcatccatgcactgagtacaggtatttctgcaggatggatgctcagaagtctaattgctgaatgaaagggcatgcaagtttcacacgttgacaggtgctgccaatttgccttccgaaggctcttccagtgcaacacccctcccaaggcagcgtgtgtgagtggggaaggctcttaagccacaaatgacgtggagccgcgctgtacttaggggctgcctccccttctgctccccgagacctggcgtggagaccgccaccaggagctccgaacacgcaggcccaaattggaataggagatggattttgataaaagaggttaaataacaggtttttccatttcaccttatacgaatgggatggggggtgggggtgctgggcctccagccaatagaggaccaagagttgtcaggagggcttataaagcttgctatttctggcattttttcctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaaggtaagcagcgggtgcccaccgccccatgaggtggaggtggtcaggccgtcactgtgggctgaagataggtgatgtctggatgggggcaggcagggacctggactggtgcttgtcacattctggaatgaagatgctttagaggggccaggaggcctgcagttggcagctccttcttggagaggaattctggaggcggtttgggctgtcctctggagagcagggtcaggctgtggccttggtgcccaggctgctcaggatcattcattcattcattcattcattcagcacaccctgcagtaggcctggccaggtgtgggttggggggtctggctgattcagactggaaacaatgggagcagtaatggggatggcccatggcttgggaggagcccagaagatacctgggctgaagagtgacaggggccttccaagaaggcaagacgggtgagaagcagctgaggacgtcaccaggaatacccgagctgcctcttccactagattttggagtttggggaatcaataaaaatttcttgccaaatttggtgaatgccaccttttccgtttgtgaagtaaggacattaaaaaataaccagttgggatctctacgcagcatactttcgtagaagaaaggacagcaacaaatgagaaaggaactaaggggacttaaggggacacacatgcccttaataggtggcagagatttcaaatgcagaaacctaacgtgaaggggccatcccagctgtgcctgggaggctatcttggtgatgggagttgactgggttgggggcggggcttgttgctgttgatggtgctgcacccagcagaccaggagacccgacctcttctcgtgctctgatttatcacagccattgttgaaatctggcttcgtgcatgtgtgtcccagcaaaagaaggctcccgctcaggtccgctttccgtcatttggaacatcctgggtgaactgggagagaccaggaaacaccagcttctgtgcctcctgggatggtttctaccttctccactctgggtctgaaagcctgcaggaggcagtgggcccaggtctgcaagggaagcctgaggagccagctggacacagaatgtagctattgagcacctactgtatactggggtctgggttaggcactgcttacatatctcagctcggccataaatacaatctgtgacatagggcaagttccttgagctttctgtctcttcatccataaaatggggacactgatgcctactttcttgtgttgtcatgatggtgtgtgtgtataagcatttacgtgtgttcatgtgtatatgtatgcacacatgcacgtgtgcacacactcactgtgtaacactttgcctggtgtgtggaaggacctcattaatgaggcatgaatgaatgaacaaatgacctaggatgtcggctcagctcatgaggagggcgtggctcacaacggcatgtgtttgtgtgcatctgcgtgtgtgatccagggagctctcttcttgtgcttaagagtcagaggctctggaatctgtttggggagcttgaagggagggccatgtctgtttcacagccctggctaataggaattctttgtgtttctggtcacttccatgggttcttgactgggagaggagttcatggcaaggactgactggccattttgaaagagaaccaaccgatccttttagtgttaacacttcctgaacaacttactgaataccactcatcagcactgtgttggtggggccctgggaaaacagccagccagtaagccagcattcagattgctacctgacgacctgtttgctgagagcccctggctgggaaggaaggtgctggaaggaaaggagtcttggaagggagagagtggctgagaattgcaccctcacacatgctccctgcctggagaacagaagctgagccaggtttaagaccttgttttaagtcatggctctgttccttacttgctgtgtgacctcagcacagcaacctctctcagccagagcttccttgcctataaaatgacattgttaggaggactaagtgggataaaatatgtaaagcacattgttggtgctcagtaaataacgtgttctcctggggagggaagaggccctggagagcttttgcctgaaaccagggtgtctgttggcacacaggggcccaaacacggcaggcacctgctgaatatttatgggaagaatgaaggtgtgcagaagtgggaggcctgagttgcagggcttttcctgccattagtaattgctgtgtgatcttgggccagttcttcatcccctttggacctttgattccctcagaagaagagtccaggctgatggcttcaacccctgctcttccactgtgttggaaatcgggtatgtgggagcctccagagcaggatgagcttcatgtttgaaattaatttcctttcctcggccggcggcatccctgatgactctcccctgctgccttgtgcatgaacaaaccggtaattaatgaaattgggagcaggggcagggaggtgaggtttccagtggaggcagctgggggtctgctggggcagcctctgtgccacccactgggaggccccgggcctgctggggcagcctctgtgtcgcccactgggaggcccagggctgcccaggagctgccatctccgtctagccagggggcctggcagatgttcacacatctggacagttgcaaagggaggcatgaaatatagatggggagatggggagtgaattctccagcttctcctgggcctggggagccattttccagggagggcctcgggaacctcctgctgttgggtgttgagatgagcctggagtagcaattgggtggacctggatttttagcctttggtctcttgacttctagttgtgaggcttgaggcagctcacttaacctccctgggtcttccttgctgtgaagagcaattgaggccatgggagcagcagccccctagtcatggggggattggtgtagaaaggcagctttgatttgcatgtcctcaccccaggggctcatctagaaggaaacagttactctcaatggcccttttcctgattcacaccctccgtcacctcaaaatgccccttctactttgtgcccactttttatatatgactgtccacccctcggcttaggccacaaatgtgggatcatctttgacccctttctctgccttactccttgcatctaatccaactgcacttgctgctggctgtaccttcagggtgcaatgacttctccccgcttcactattacttgtcaccgggatgaccgcaggagcctcctcccaggcctccctgcctccacccttcctccttagtctgttcttctcgcagcagccagtgggatctctgagaaccacctgatgcgcacatccctccctgcttaaagcctgtggttggttgtcttttgtaatcagctggatctgttctgatacctttaatatacccacctgggggagctgggcacctgtctgatctcactttttgcagtccacaagctagcttctgcctcctgcagaatcactgtcctgccacctcctaaatccgcttccccactgaccaagctattgtgcctcttaattttactttcagacccctttgtctggaatggttcttttaccccttggactcctgtttattctcgcaggtgtggtcacgacatccacggctttccagaagccttctctgattgcccccaccgtctagccgcaactatcagagccagggtccccttccctgtgcccgcttctgtcattgtcctccccatcagtgctgtgatgctctgggaggacatcacccacgatgatgcacctttattctcacacgtgctgcaaggccagacagcacagaaatgttaatttaggcagtagatgcaaaagacctccctgcaaattaagggccttcagacctagacagactggaataggatcctcaaactggtttgatttggctgtgaccttggacaagccacctagcctctctgctttggagggtcacgaggattgacgagatgacatgtataacaaacatcctcctctttcccacttgctggattgtaagtgttcccaaagacacttggaatgtttaacccctcacatctgctctgagcagagcaaactcaacaatgcatagacgagcccaccacagaaccccaaacaggagcaaaaatagcagccatcggggcaacctgagatgcagaagccacaggaagaagccgcaggccaagcggatgtcagcggctctgaggccctgctgaggttcctcggatgtgctgagctctgcagccctctcgcctgccctcgctggctccccaaccacagcatcagataaggccggtggaaaaagtgctggcttcctctttctggggaggggtaatctcagtgccatctgtggggcacactccatccccagttgcctctctggcctcccctccccctccccactgcttgctctgcctgtctttgctggtctctttgctgaccgaggtcacacctgccggcagctcccatcttagggcctgtacacaggctgtcaggccctggaatgctctccccaacacatctacttggctcactccctcacctccttccagtcttggctccactatcacttcctcaatgaggcccaccttgactgctctgtttaaacgtgcataccctccatctcgacattcccaatacccctcacctgctcaactctttcttctttccatataccatgtaagtcacttattgactatgtgtattgttttctatctccaatgcaagagcgtaaactccaggggtctttgttcactgctgtctcccaggatcccagaatagtgcctggcacaaagtagatgcacagcaaatacttttttggtgcacggacgcatgagtacatgagtaagaaccagcccagcaatcagaagaggttcaggctagattttggggtgaggggggtttgtttctgggctccaggccccagggatgggctcacgtagtcattaaggattctggccccatgattgacctgcattggccagaagcccctgctgaccttcagggcgatagctgtctggggccagagaagggtctggaagcctgtggtccctttcaggagggacccttgcagtagttaagagtttggctttggaaccacattgctgtgggtttgaatcccagctccaccacttcctaggtagatagccttcacgtctacctctctgtatttgagttttctacctttaaaatagagtagataggccggtgtggtggctcacgcttgtaatcccagcactttgggaggctgaggcgggtggatcacttgagtaccggagttcaagaccagcctggctaacatggtgaaaccccgtatctactaaaaatacaaaaaaattagccgggtatggtggcgcacacctgtaatcccagctactcgggaggctgaggcaggagaatcactcgaacccaggaggcggaggttgcagtgagctgagatcgtgccattgcaatccagcctgggcaacaagaatgaaactccacctcaaaacaaaacaaaagtagtgaattctgaccttgcttgggtggtgattatgagggttacatgcaatatagataaagtgcctgactcatggtagatgatcagcaaatgaccattactattaaacttattatgtttttttttttttttttttttagagaaagggtcttgctctgtcaaccaggctctagtgcagtggcatgataatagctcactgtagcatcaaactcctgggctcaagcactcctcccatcttagcctcctgattaggactacaggtacataccaccatgcctggctaattaaaaataattttttgtttgtttgtttgtttgtttttttgaggccgagtctcgctctgtcgcccaagctggagtgcagtggtgcgatcttggctcactgcaacctccacctcctgggttcaagtgattctcctgtctcgccctcccgagtagctggaactacaggcatgtgccaccacacccggctgattttttttttaaaatttttagtagagatggggtttcaccatgttagccaggatggtctcgatctcctgacctcgtgatctgcccgccttggcctcccaaagtgctggaattacaggcgtgagccactgcgcccagcagaaaagtaatttttttttctaagagacggggccttgctatgttgctcaggctggtgtcaaactcctagtctcagctatcttctcgccctggccccccaaagctctggaattacaggtgtgagccactgcccctggcctaaacttaactgagcatgttagggttatgctgccgtaacaaccccctgaatctcagttgcttatcataaggaaggcttatttttgctcttactatgtgttccatgacaatcagcagagaagtaggggttgggctctgctccacagatcactcagggctgtaggttggtcaagtctcgaccatctggaaccttgctggtcctctagagaaagcctgcagatctcaagtttgcttttttatacttctacccagaggagacccacgttgtttctgctcataacccattggtctaaactagacgcatagctccaataaatggtaaggggagcctgaggtgtagtgtcctatgtgccaggaaggagaggagagccagatattggagagcagtagtaaagtctaccacagcaggtacttccctctctgccctctccagacatataggcagactgagacacagttagtcggtacttacgggactcactgtgggtggctgaataatgacccctaagtatagctaggtcctaatctttgaaacctgtgtatgttactttaaatggcaaaaggggctctgcagatgtgattaagggtcttgggatggggagagtatcatgggttgtctgggtgggccctataggatcacagtggtccttataagtgaggaggggttgcagaatcaggagaaggtgatgtgaggatggaagcagagactggggtgacggctatgaagatggaggaagggaccacaagctaaggaacacaagcagccactagacacagggaaaggcaaggaaatggattttctcctagagcctacagaccagccagccctgatgacaccttggttttagcccagtgaggctgattttagacttcgggctttccagaactgtaagagaatatgttgttttaagtcacctgtttatggtgatttgtgacaacagccctaggaaactaatatatcaccttcagtcagaaaatcatttgagacccagtgcatagaagccgcctctgtctgctcagacagaactgaccccttcctcctgtctgttgtggcgccccttgtacctgtctgtcatcacgttcatgcacaggcagaggtgtctcttaacatagtccttccactcccaacccgcatgctccaacatgtatgcccacactctcagccactctttgagcctctcattgcttgggctgatccgggttggtgtgtgtccacgtctgtaggaatgcagggcaggctggtggcaaggtcagtgtaaaggacttgtctctggggaaagggccctggcatgccccaggagtggctcagttggcgggagagtagaggccctgtggaagatggtgggagggtgaaggatggggctggagaaatcagcagggaccaggtcaagcaggaccttaggaccaagagaaagaggtggatctttgttttgaggacagagaggagcctagtaggattttgagcaggggggcgactatggatgactgatgactgggttctcctggtttgcgactaggttagaagactgtctttgtcctcccatcttctggaagtcaactctatgccagacactcctgagctatgcttttcacaggatttctcatgcatccattttatagaggagaaagctgagactcaaagaatggaacctcatggaatccatcctccacgtggctagctgagtcatcttttaaactataaattaaagcatgttactcccctgcaagaactctccaagggcttcccatctgggatgaaatccaagtgccttatggtggccctaggaccccaaatcacgtccttgcctcgcccctctgcctactgtgtcctgcctgttattccccctgcatgcgagagcttctacttgtggacctcagggactttgcattgctgctccctctgccttaaatgctcccacccactacttgttgcctgacagcctccttctctctcttctgggctccctcagtttaattgctgcctctacagagagaccctgtctccacacttcctgtgtttgctgcacagcacttagcacaatgcaacgtgtgaccacctttgtgtgtttgcttgtttgttgcctgcctcctgcagtggactctgaggcctgcaggggctgggactgtgtctaccttgcttctcgttgtgtcccagcccccaggagctggtatgaagggggcactcagcgaacaaacctctgcggaaagatgaaggatgggtcctgtgtgcagagggagctctggacctttgagggtggctggaggctcctggacctgccttggaggacagacaccaggcaggggccagctgaggaggagtgccagtgatttctctgggcacctgggcagccccattcctattgcacctggccttgacccactccctgtgctgtctacattctctgtcacattaaatgctctgcctgccatttcagcctctgggaggatccacgagggtgtggggagagacgtcagacctgggtttggatcccagctcagccacttaatagctatgagaccttgcacaattccctttaactttccaagcctcagtttcttcctatgtaaaatgggcatacagagggacagccttctagcacgtgactcctggtgcttgattcgcttgaaactgccttatctacaatccaaaaagccctgcgacgagaagttgttttgtcaatatgctgcaaactcatttggcccccaaaatctgacctgagctgacgcgaggctctttgtaatctttactcaccccacttgtgtgaatattcatatgttccactgcagaaatatgaatgtgttccattgcaggtgttgcctgaggctccactgaagctatggcataatttgcagaatttgcacttcattacttttctgaaattcaaacaaattctgaaactgcacgagttctggctgagagctgtggatctgtgcatgtgagtagctgctgaaaaccctcctgggtcacaggagggcccatgggggcctctggcagccatcgcagagcctgaaacccgttgtttccccttggctggcttctggtttcttggcagccagtgtcttcttagccacctggggttatgttgggttttgctggttcaggggcaggggttaaagcttagggcagggtgagccgaggtactcagacatttctgatgtgaatttaaaaggagaatttttttttaatgaatcatcagaagaaagaaatcagaaggaagtgtgtgaccaaggagaggaaattagggtttgcaaattgcatgagtcaccccctttctgactcctgggtgatcccttgcccttggcacttttcactcatctctgagactctcaaggccgtattctgcataacatgctggggctgtcatggttttattctggctccaaacctgcttctcattctagccatcagtataaatttctagttttgaatcactgccacgctgttttacttattattgtgttagccagtgtttcttccctgcccaagccctgctcagactcccgtttccccatcttagttagcatctacaacccattctccacccagaagccagaggccagtttctgaagtgcagcccacattccgggtttcagtctcatctccccagtgtggcccttgaagctcccttgtgataaggccctgcttgcctttctgtcttatcttgcaccgccttactattccatgaatgggcccttccctccagctcccaggctttggcaaatgctgttcccactggcctctgccctcgcctggctagttgtgtgcatgctgcgggtagatctgcttagaagccacctcttccgtgaagtctttttacaaggcccttgtctaggccccacgaacctggcttcccatctacttatcacccacccatattctgattcctggtcctgtccccttccctagaccatgagctccgggacaaagactgtgtgtccaccaggtgcagtggctcaggcctgtaatcagtcctagcactttgggaggctgaggtgggtggatcacctgaggtcaggagttcgagaccagcctggccaacatgatgaaaccccatctctactaaagatacaaaaattagttgggcatggtggcgcatgcctgtaattccagctactcaggaggctgaggcaggagaatcgcttgaacccaggaggccgaggttgcagtgagctgagatcatgccactgcactccagcctgggtgagagtaaggttctatctttaaaaaaaaaaaaaaaaaaaaaagactgttttctgtatatcactttaccatccccagcactcagagtaaaaggctgttttaagcaagactgttttaagcccttgagtgctcgtcccctgcctctggctagctgtgtctgcctaagagtggccaccatattgtcttccattaggctggaacccgtttcccatgtccgcagtggtgtgaaatatcccagttgcattgcagtaagtttattttatgtgcatttccccacttgccattgaatcaggtgtcccttttttcccttccatatttgtttcttaagatatcgcctcttgtgtgacttttgtttgaatcccatgtctttttgtctgttggcatcttgctttctgtttaatgtgactgagccatttctaccttgtatatattaactgtcttatagttggtgctgatattttcttagtctgatgtccttttcattttggttttattatgttttcttccacagaagatattaatgcatatatatttgaatctgtcaatctctcttcctctgtgattgcttcgagggctgaagaagttatcctgctccacagatctgataaacattctgttctgttttctgattgtttccctgtaacatgactttttatgtttaactctttaatccattcggagtgcatgcattttggttggtgtcttgcagtgggtatctagttcactgttcctaaatagggacaggataaccctcttgtccccattctgtttattatataattagcccttgtctctttgtttgcaaaaggggagacaaaatatagtagctgttataagcgtgagctttagcagaattaagattttggctttgccactttctgtgtgagctatgagcacgttgcttaaattgggcttgttttttcctctgtaaaactggatgatatcttcctcctaggaccgttgtcaagattgagcagaagatcatgtgcaaagcacatcacatgttacctggcataaagtaaatgccctcttttttttttttttttttttggcttaaacaaatatttattttctcacagggctagaggtcagaagtatgagatcaaggtgttggcagggttgattccatctgaggcctctgtattagtttgttcttacacttctataaagacatacctgagactgggtaatttatgaagaggtttatttggctcacgattctgtgagctgtacaagcttctgcttctggggaggtctcagaaaacttacaaccgtggcagaaggtgaaagggtggcaggtacacttcacatggccagcaggagagacagagcaagtggggaagcgttacacactttcaaacaaccagatctcatgagaactcactatcacgagaacagcaagggggatatccgcccccaagatccaattacctcaccatgtccctcctccaaaattgggcattacaattcgacatgagacttgggtggggacatagagctaaatcatatcagcctctctcctaggcttgcaggtggacagcttccccttgtgtctttacgtggtcttccctctgaaatgccctccttaatcttgatacgtttccatacctagttgggtccaacattgtacttttccttctgtttcattgattttagaattcttgttttctgttactgccacactgctttaattgtggcttcacggaatgtttcactctctggccagattgggcatccttccattactctttctttaagaatattgctttaaacacgcacctgttttctttagtggatgttgattttctctctcacattctgtactgtagcctacctcagtgacttctagacaccccttcttccccttccccagcacacataccggttttcccccaacctggctgcccagcctttgctcactctggacccactacctcacaggtatgtaccaactgctctcacctggcctatctccaccttagtgctttatcacccccctccaggtgccattatgcagatacccattttccctatggacctgagcttccctgggaattggttctaggtccctagtgcccctctgcacctggcatatggccaggtacattgtaggtgctgaggtcagggcttggggaagacaggaatgttcaccgtgcccttgggcttttgacagtaactgggctaaatctggcttcttctggaggtgcaggcttacaggactcaacaatttggtggttgtaaccctggacatgctcttgccaataacggtgggccatccatcagccctggccttggtttccccagtgggatttgcagaagccagaggattaaagccctcccagccctgaggcctcattatttatcttagtgggtccacagtgaagatgaattagaataactcattggcacatgccatgccttggagtgcagttttctgttttctgggagagaaaaggcctcttaggacagagccccccactgccctcctgggtctccaggagacagcccagatctgggtcagaagggttcaatagtcaagaacagaggggtggctctctgcctgggaaggcaactggggtgaaagcggggagctggcctttctctgcatactgctaggtagcatgcaaaaccctgcctgttccattcctgttctccaggggaggaatctgaggacgagaggggtaagatccctgcccactgccatgcagcagcttagtgcagagcctggacttgaacctagatctgcctgcttccagagctgtgctgcaccagtgttctcgcagctcccagtccaaaggccgacgttgagacagcgcttaaaaatatatcagcagtgtttacaaataccatttcctgtgttatctggtactgacagaaggaagtgaacctggcactttgtctgtgttaggtttggggttagaggcataagtgccaagttcagatgacctagaaaaacctttctaggtcaaattacaatttcaaagatttcttttcttcttctttttgaaccgctccaagatcgaacgctgtcgttgacatatttcccttccgacaacacgagccttttgtggcatgattgagggcttgttttgtagtgctggggagaaaatatcttccacatcatctgctcattgtctcagtcacactcgttccccccacaccacagtgcaacccgacgtacgctcatgcggcttttagttaattgcctttggtaagaatcagttttgggacttgttcccaactgcttggatgatagataattgtcaaatacaaatattggcagcgcagggcaacctgaggctctagactgctgactgcatcccagcctctagggagagctgggagctggccagctccatgttatgggaggtaacggggcaagacctggcaggagtacagccttctcattagagtgtaggctctggagttgaacttcctgggtttgaatcttcattccaccccttcctagctgtgtggccttgggcaagctacataacctccctcgacctcagtctccttttctgtaaaatgggagcctcagtaacttaccttgtgaggttgtcgtgaggattataggaacggatgtttgtcattcaattaagagtgcctggcttgttgttagtgtgatgtaaacattgcatgcattcgttctaatgagtaaatgatcatagccattagtggatgctcttgcgtgtcaccctagtccctcctcagatccaggcacacattctgtcagctgcttagagtgttggctgctgcccctatcagctgagcctctctctgggcagctccatggtgcctttggtggaaagaggaagccttggccaaggtcatcaacactcaccccctgggcatcctggatccgatggccatcccatgtggggatacagaatgcttagctccctgcctcaaactgggacacctctgctgggccatcccagttccagagctccccttgggacaggtggaggcctccgttgtgactacatcacagtttggcttgtccctctggcctgtcctgctcccccacttccctatagcacttcccagtacatttcttgtctgtagatttcacactcagagtctgtttggtacctgaaacaacaggtagctatccagacgctgaatggaatctgatttccattttaaagcacatgctgatttcacttgcttgtatttttggaagctttttgaggagtggccttgggttctctaccactcctgtctcctaccctgtgtgtgcacctttcgggcactgtcagcatgccttggtcacctccatgactcctggtgggaagaatgtggcctagctcctgggcagaccataaaacttaagactgatggaacggcccaggggctcagagggcatcacccattcaacccttccaggtatgaatgaggaaactgaggcctagaaagggggaggcctttttcaaggacacacagtgagtggtgcctgtcttttccatctttgaaggtgatggtgtcttgggatatagtgagcaggctggtcttaggagccagacatgtggctgttgtgatattatggcgctagggtccaatacatgttttacggggtgcccccatggcagaggggtggccaggccagcccaagagtggctatcagcaatggcttctggaaggaggacagcacaggagttgaatgggcatgaacggtgtggaagagagaaagcagggagtttcaggtggagacacagctgctgcagaggtctggatgaggtgtgggggagagtgtgatctgggcagggggcttggaaaggcagaagaggggatgggcgcgtgatgggtgggaggcagcctggactgttgggctggcaggcggcagatgctcaagtgaatgttgtggccaagaattaaaacttttccccagtggaggggatgggacttgatggagagtgacttggggagagccacgcagaggccttacccatcatggtccccactgaccctgcactgcctgagccaactgatgctcagtcaatggttgtggaataaatgagtgaacgaatgagggaagggaagatggtgctgaagaggaggcctccagctgcactgtggcgggtgggtgggagcagggacgagcccacaggctctgatgaaactggcttttggttgggggttttatccttctgagccagactgtgggtccctaccttccctcctgtcactggagaggtccatgggcctggcttcgatgagactctggggacgtggggagtgccggtgggtgagaccagccgagagcacgtacattggcatcccccacagcagaagcccagagaaaggcctcaaagtcgcgagcccaatcagatgaggtcctggccctgccccttggatggcctcatctcattacaccttgacccacttcccagcccagctccctccagccccaggcagcgtctgcagccctctttgaaccattccccctcacagcgccaaatgaaaatgtttgttgaaaacaacatgtgcataattaaagcttaatgagcgcttgtctgtttggaatgtgcaattagatttacaatcggggatgggagagagctccaaatggctttaaatggagctgagagagaggataatttttgccataaatctgcagtaatgcagacggtgtgtgagctaccagtggcagtaccagggaaggaagaaatacaggcctgccaggcctccatgctatctatgttagggggctgccctgcccatcaggcccggccctctgggcagctgcagctggtgagtgtactgggatgggactcactggtggtcctgggggcagagctgccctaggttggagctggagttcctgcctgcagcttatgagatctgcgatccagccaactgtgaggggctgaggggctggtgctgagtccagctgcccaggtccccaggatcccatggctggggcgagattcctgcgtcatcaccacgttcacccccagcctgcaaactggcttcagggcagagccctagactgggatgtggccctctactttgttctctgctgtttcccagtacccagagcgtacatagttaaggcctcagttaacatttgttggatgaatgaatgcctcgttaccagactcttgccttcaacaggtcactctccctctgcaaaccccatttctcccatatctatcacagagaaatggattcggctactgctgatgatgtcagctcttccgtctctggggttctgggtcaggagcagataatgactagggcagtgtctagaccagcaccatccagtagaaatacaatgcaggccacatacatgattttaagttttctaatagccatgttcagaaaaagtgaaaagaaacaggtgacattaattgtaatactttagttaacccagtatatcccaaatattaatattattccaatacatcatcaatatacaaatattgacaaggtattttgcattcctttttgttgtcatcgtcatcattcttgctctgaagtctttgagattcagtgtggactttatacttacccacatctcagtttggactaggcacaattcaagtgctcagaagccacgtgtggtaagcggccaccattctagatggtagaggtctagaaagagcacagttagagcgaggtaggtgggagggggcaatgattcccacctcccagaggagcccaggtacctggcagccctcacctgtggtgctatagtgaccactgccatttttacactacccctcgatgccttttattgactgaaataggtggcaccatccaagccaactcttgttgggggtggggacaagggtcctgaaggggcccacagcactgagcttgcttacaagggacattcccagctcctgcggcaggcagtgcccaaggcgttgtccttgcttctgatagttaaggtcccaggcctatagtcatgaggtcaccttctctggttcacgtggcttggaggcagtgggggtgggaagccaggatgtactcttaggagtcagcagcctggacttcagactcagctcaggcaggtcttggctgtgtggccttaggcagatcccctaaactttccgggcctctgtgatggggaggatttatcaccaggcagaatacgaatgtgcgttgtgcccagcaaagcaggcacaccaatcaggagaaaaacatttttgaagaattgttaatatctgatattttaggaacaaagcatgaaaatcatcgttgttgggaaaaatcggccctggcagttggactttcttataaagactttaatttgcaaattttatttcaaattacatacagtgggcacaggcatcgagggtcttttccatgattaagacctcagagatttgcacaaagccccactcagtttcttcatctacagaagagaggtagttatagcaactggcaggattcttaggaggattcaataataaaataagaaatagctaacaatgattgagtgccttctctaggtaggcaatgttctaagcactttccgtatatttatttaatccaaatgatagtcatacccattttgcagatgagaaaactgagacacagtaatgtagtttaaaaaaaaaaaaaaccaacagcttgaaagcaacaagcccaggatttgaaccctggcagccagaccagggcctgtgtttgtatccactgtgccatcatgtttctccaagtggtgatggacctggagttggtgtacagggcccgggtcaggctgagactgaggcttcccaggccgtgctctattcctgttcctcttccatctgtgccgggctctctgcctgcacccctcccccggcatcttcctggccctgatgtgtatttccccatgagacttccacataaaaccgcactctcggcaggacctaggttgcagctgtctctctctttagagctgtgttttatctgtgcagaatgagcgttctcaccgcccaatgtggggcaggcgggagcagtgtgtgctgctttgattgtttcctctttagatcttggtgaggctcagctctcagtgcctgtgactggctaggctgagggctgtgcatccctaggctttgatctgtgtctctgtgcagaggggaggagcaacagcttctacagaacagctgctgctttggtacctgggatcaaggccaagttcagacttcctgggtggctttggacaagttcccaaccactctgagccttaccttgctcatcttgacagtggggctgctgctcatggaagccttgggatttctagggggttccagtgagatggctggtcacagctctgggataagggctggtatacagtaggtgctctttggccagtgctcacagcagccttggatgtcatattccctgctccttgcctagtcacctcctttgcttcctacatcatggagcctccaagtcactttttcaggatgcttctctggaaagaccctctgccttgcttctgctccccttggctaaccttatcctggcctttgtcacatgtgtcaaagaagaaggcatcattcaatatcgaaagcaagaagctgaattcattggtatacttcgcaagggtagtctccccaaatcaagcaagaggctgatcttttcagggtttggggaagcatggggtcctgggataggaggactttcagagcaggaggttctgagactggctggctgtctccgtggtggacatgtggctattgggagtaagactattgattgactgactttcagaggtggggctgtaaagctcccagtgacaaatgaggatgagctttaagctggtttggggattcattgtttgcagcttgggactgtggtcaaagaacatcttttcctttgtagatttggagaataggaaggttttattctccctccatagctgtcatcttctccaaaggactgggggttccttgaaggcaggggccgtgtcatcatcattctggcatgcctggcacctagcacactccctgtcacatagtaagcacgcacaagagatcgttcaatgaacagtgattgttgcctccaagtccctttgcttttctctcttttcagtgcctttgtgatgatctatttgcatagatttcccaaggggcagtggcaaaattcacttgtagattccccagtggctgggagcatattcctcagcacgagatatgtgcctggtacacgatacaacaaaggcactgcctggtctcatttcgcctcagcacatttgaatgagatcttagacccaggaccaagagtgggagcaaatgggtagaagacatgggagggacagggtcaaggtgaagaggctgaccttgaacaggagagagataccttttcagactaaaggaaaggaagtcaagatgagcatgatgtaaataacgtaggggaggttgggagaattgagggaatatctgatggcttcaattcctcagtgacagaggagacaatgtcatctgctagactgagggagatgggggctgataaggggataggagttgatatatcataacaatgataataggtaacatttattaagcacctgtcaaaaatagttaatatctgtaacataatgcttaataatgctaactcatagctgatgtctgataacagataccaagaaccttatgaggtaggaatgtagctgtcataattgttgttttataggtgaggaaaggaaggcaaagtgaagttaaagtcactgagctcgtaagtagtggaaccagtcgtcagatcaatgctgttacccagtatgttacactgcacataggagttgaattaagtccaaagctgattttagatggaagcttttggttaggtccaagaatatgggtttataaaagcaagcaagacagtgttaaggttggagtttgtagccagaaataaagaagggcctaggaagaggtagatttcggtggatagagaaagggagagtgttccaggctcatggtgggacgatgtgtaagagtgggggcacttgctgggtgtggtggctcatgcctgtaatcccagcactttgggaggccgaggcaggcaggtcacttgagagcaggagttcgagatcagcctggtcaacgtggtgaaaccccgtctctaaaaatacaaatttagccaggcttggtggtgcatgcctgtaatcccagctactcaggaggctgaggcagcagaatcacttgaacctgggaggtggaggttgcagtgaactgagatcatgccatttcactccagcctgggcgacagagcaaaactctgtctcaaaaaaaaaaaaaaaaagtgggggcactggaggctcccactatgctgaggacccacgggaactgagacttggggctgccctggagggtcctggatataggctaagtgatgtggagtctctgcagggtttggatctgaggagtgaagcgattgcccaaatatcgctagtgatagccaaggtgtacgatggattgtgtgacacggacccaccaacaccaacatgggtttgtggtgcctgtgtgtgcccctacgctgtgcataccacatgcactgtatacctttgtgttcacactcagcatactcttagggaagctcagcagaaggatgttgcaggtgattggatcagagggatgtagatggcagggagaccagagtcaccccaggggtactgactgtgggactgtgtggaaggtgacagtttctgttaagacaggggagtgctggagaaacagcaagtccatgtacatgttatgagttcagtgctggaggtgttgaatttgaggtgctcatgggcaaatgggggagatagggagaaaactatatattagaatctggaggtaatttggctaaagatgaggatttgagaattggtgatgttgcaaccgtgagtagccatgacattttccagagaaagtgtgaatcgagtgagaaggaaatgccagacccacattgctatgcgcctatccattccacccaaccactcaacccattttacccacccgggaacccacacgtccaggcatctatccacgcatccccaacacccatctcacccatccatgttcatctcgtccaccatcccaatactcttcccatacacttgtctgttcacactcatgcagccatcccttttcacctatccattcatccactcctccctctcatcccagccatcccatccatacatcccaaccacccatctatttgtccatccacccatctcattaataaaccattcattaataatcattttatattgattacatgttgaaatcatgttatgaatatgttgagttaaacttaattttgatgatatattttatttatctgttaatatttttaaacagtggctactacatttaaaaataatgaaaagagtataattggattgtctgcaacacaagggataaatgcttgaggggatggaaacccattctccatgatgtgattattacactttgcatgcctgtgttggaacatctcatgtaccccataaaaaaaactgtggctactagaaaatgtaaaattacatatgtgggtcacatttgtaacttttattatatttctgttggacagtgctaatgtgtacaatccctcacccatctattcattcacccgtccgtcatctgccgatcatccgtctatccatcacccatctatcaatcatctatccacccatccattcgtccacccatctgcccatccatccatcccatcctttactccttcctcctttccatccattcatctacccacttatcacatctgtttaccccacaaatattttatttatacctgtcatgaatcagtgactctgtggtcataagaatgagaaaactgaggcttaaagcagttaagcaatttgcccaaggtggcacagatggacctgggatctgactgtctaagatcagggctcctcaccttggctgcctatttgctaagtttccttaaaaaatcctttggggaagcatggtgtgcttaggttgggggctggctgttggaataggggccgaggagctcttttccctgaggggaccacacagggaaaggagaggtaggggagagacagatgccttagaagcccctgtaagctgtgtccccggtggccgtcatgaaagggttatccctacacattcgatatttgcaaaaatgtgggttctttcagattccaaaactcatttccatgacaaaactcttgggaagagaagatgaaggcctggcttttgcagaacaatcttccagctgtaatgaggactgaagatggcaatgggaaaaggaattataattagaatatgaaatggggaaaattaatctattccagtcactggtaagaggatgttctcctggcgttcatggaaattcttaagctgttgtttctccctgcatttttttctcacattttaaagcatagggaaggctgtgtggtatgaaaaaaagatttttgaccaaggaactgataaactgtgaaatatgcatagaattgaagttcatgtgcatctttgctttgtatgtctctgtatgcacattcagtatatgtttgtgttcacatttgtgtgagttacatttaaatggctgcagatgcatggaatgtttgtacacatatgggcacaccctgctttccttgtgtgcgtgctgtggttattgtgtgcccagttgtataaaggtctctgacatgtgcacactcatgcctgtgctgtgtgtgcgttggttggtgttacccatggacatgatacatgagtgagctgaacgctgccgtgttgaacgctgtgctgcatgacctgggtccacacaaacatgggtttgtggtgtgtgtgtgtgctgcccatgctgtgcacacggtgtacatcatatacctttgtgttcacacagtgtatgcactgcggtgggtgtagatgtgggtgtttttgatcttgtctgtgcacatgtggaggaggaagtagccctgctgtgtctgagggcagaggtgactttgtgacctctccccttggcttccaagttcatttagccagaaaaggtcccaaatgaggagggggctgcaggggtaagccccaggccttagagtactggaagccaagccagagggagcctgggaaccctcagtgtcccccaactattccttcatgccctccaagggctccgatgtggtggaaccctggcagaggtgggcaaagaacaggcctccccgcccactcagggcctctgctcactgctgctccgcagctggttctgagcccagcaggctccagggcactgtgcaaggtgcccaagggtaactgaactgaggagactcaggccctgcctcgggaacctctgccagcttctcaagtgccccttgaaagccagaagcaagctttactacagcacgtggcagctctttcctagacattggttgaataaaggagtgaatgaataagacaggctctggtgacctcatgggaatccactgcccacccccttgcctgcccctaacacactcgtgtcggagaccaggcccccttgccctacatctccagtaccattcccactgctctctgtggataattcctccctctcctgaacctctaacacacttatcaagcacctgttatgcgccaggcccaaggcagactattgattatatagtaggctctagaaaagcattggtccctgctgtgaatgcacttgcagctagtgggagagtccaagcagaaaaaatccaacaagggactcttaaatcccatctctccccagctgtgtgatcttggacaactgcttatcctctctctatctgtttgcttggttttagcagggaaaagaatattttcttcattggatcatcgtgaggattaaatgaggtcttttatgtaaagcattttgctcagtaccaggaatattcattctgtcaccaaatatttattgattgtctactgtgcttatcggggaatgaagcagatgttggcccctgccttgcagtggctctgttctcaccagcatttaataaatggtgaccattcaaaggttttttggacatctttccctctgtttctcatgcatattcctataccatactgttcgattactattgctttataaaatgtttcaaacacttcattaaacttaatgttcctccatctccaattattcttcctattagggtctacttataagttacatgtgatttttaaaaaattttacttttgtcaaaatgatcaatggccatggtcacacatcaagtcaagtacccaggagcttttgctgagagcgcccccaccctgcctaatttatagccccatccctaatgccaggctctgggagatttggagatgaccagacacagttccagcctccatgttgcttccactctgggacagatgacaaatgtggagacagtctatgttataagagcaacagccagaggagatgcgagcatggcaggcctcctggaggaggtagcctctgagcagggtcttgcagcatgagctctgtgtgcagtgtggtggatggagtcctgcatttggggtcagtgcccaaactctaggcatggaagaacctttttttaaatcatccagtagtcaccaagggactctccccgtccctgtgctggggaggctctttggtgtaaccatcaacccaactgcctagatgggaagataggcctggtcagaggtgatctgcatgtggtagtgactgctttatttacttattcaacaaacatttattgagtaccttctctgtgccaggcactgttctaggagcttgggagacatcaaggtacagatagacaaagatccctgatccctgggagcctccattttagtaagaggaatctaatcataagcaatgaatatagtaaatatagagaatgctagaaggtaacagggacttcggaacaaagaccaagggaaggcggggcgagggcgcgtcgaaaatggtggtagaaagggtggtgggctctcagcccacaggggctggggctggcatctgagccagttatcaagcaaagcttctctgagtgaaggcggctgggtaaacagacatttcacatggttgtgggcgtgtggatttctacggcctccgtgagggcagctgggtgatgtctgtctaaattacaaatgcacatacagttggatccagcaattacacaaatgaatcctacagataaactcacacctatgctcaataacagatgcacaaaaatatttatgggagcaatattgggatagcagaaaactagaaacaatgcaactacccatgtgctcagctagttgaatatatgtgttatatccacactgtggaatactgggtacagaaaaaagaactatgttctgatataaaacattttctaagatgtgttgctaagagaaaaataaagtgcaaaactgtatagcatgctgtcatgaatagaataaatgactctaaaatgtgtatatgtagacagtctttgaaatgatataaaaaagctggtagacgttgcctctggagaggggcagtggatggctgggaggtggggtggtgttgctttttgtactcttggaattttgaaccatgtgaatatatcttaataaataaatggttcaattaaaataaaatggctgtttgctattggtgccccactcagaaccctttactgaccagcacagacatctcccacctgccttgagcacaagctgcctgcaaatggctcacagccagtatagttctctgaagacttgtgcttggtcaattgggggccaccttgctcagaaggttatgtctccccatgtcccctaagggcagcccatggcctatgacttccttacctgggctacaacagccaccccttgcttcgtgttggtactaactctgcatacaattcatgccccagagttccccatcagagcaggctgaaagaagtcttcaggcaagaccacatccttgcttagctgtacccactcctgtccggcttgcctcccacacttacaggttattcccaaggagtactttcttaatagccacatgcatctgaacccttgcctcaggctctccttctagggaaccctatctaagatacctagcttaagggaagggaactaactggaattaagtcctctccatattaatgtgttgagtcaagtgctctacagtgcaacatcctatgaggaggggcctacaggcaccatccccatttaacagatgaggaatctcagaagttgaggcaccaacttgagatcacacttcagggcaaagagggaggcgggggtcccagagcccacatctcttcccctgcacctgctcctgactttttaggcagatttacagggaaatcttcctgaatccagacttagcagcttctctgcacacaggatatagttcctgtacatggtctctaccatagtcctcactgcctgtagccaggcgtggccctaggggctgggatggcataggtgatgggccaaaaccactcaggatggcaggacccggagggcatgtctggggaaggctgtcatgatcccaaggctctggtgttcttggcctcccccagcacatgggattccagctctagctgatcacctgatataattttgatcaagggaggtgtttgcatacttccaaggatgggcagctcagcacatggcaaggcagcctgttgtgtctatggacaagttatagagggcagaaaggttttcctatttgcattgtaagtgtgattaacagcatgaacctgagcactcaagggccgtggaacaggggctgctccttccaccctagaggtagccctgctgaaatggggctttgggcatcctgggctctgatttgccttctgcagctcccacagtcccctgcagtcagtcccctgccctcctccggctgcttctcctggtgccttcctgagagcattttaatcagagctgcttctccctctctctctattctagtttgatggtgacagtgcctacgtggggatgagtgacggaaacccagagctcctgtcaaccagccaggtgggtgcctcatcctccctgaacgggtgtcttaagatttgggctggctggatctgagctgttcctgggtggaggtagggggtgcagaatggggccagcacagcccgctgctgtcttctctctgaatgatcaagaatagcaatagtctccttaaaaggtacaatcaaagtgggactatagtgttcgtaaattaactacctggctactgttggcttaaaatggattgggaacttgatgaaacttgaaatgtattgcccatactccccacgcttggggcagcttttcagcagcagtgagttgaggtgcctgctgctctctggtgccgcctgcctcttgccaccacacagcacccacggggacatgttctggtttggatgcacacatgcccttgcgtaggcatgcatggttctcctgcctgctgggagttgttgaaggccacaggggagggttgtggacagggcacaaggaaagagagcagaaggtcttactggtggcaaaggaagcagagtcattcctgggcaaggctgtctcgaaccccagcctggccctctggggggtcatagttgccagttggaatcagattttccactgagagcctggtctctgaaaattaatgtttctctcagctgggagcatcctcactatagactatgatgccacagagggtccttgctgcaggctgagggtccagggagggtctccctgcagaatgtgatgccagggtgggtcctcactgcaggctgggaccccagggagggttctcactctaggctgagatcagggagggtcctcactgcaggccaggaccctggggaatgtcatccctacagaaagtgatgcaagggtgggtcctcactgaaggctggggccccagggagggtcctcactgcaggcgggggccccagggagagtccttactgcaggccggaaccccagggagggtcctcatggcagaatgtgataccaggaagtattctcattacaggcatggcatcgtggaggatggttccctaaggcagtggtgcttgctgggtgggaccagctcgggacactgattggagagccaaggagggttatagctgctgagaaacttgggaagctggagggcaaccccggccctggagctgacctctaccctctgtctctgccattgtgggggctatggcagtccaagttgggtggcccctcagccatcaggctgggcacatattttccagatggggcaatagaagcctattaattcacaaatatttatgtccctattctgtgacaggtcccatggaggccatagatgagtaagacatgggcctgtggccctagggggcactactagtgaggaagatactgtagtctcagtggggcatggaagctctgctgcagggtgctgcgccccctcccctgccgctgcaggatcgctcatgccggggccaccataccatgcccctctctggcctgtccctgtgtgagcataatgctgctgctgcaaagctgcctttatattgcattgacatgcgccaacatgcaagactggtgggcaagactccaggccttggaagtggttattttggaagagtacactgatgtcatttaattgtacataatcaactgaagtctcatctcagcagaccagagttagccctgacatctcatctgagccttttcacaatgtttaaatagtatttttgttaacatattgagccctggttttcagaactatattatggtgaattctgttctggaacctactggaaagcattggcaatgtccttccaccaagaaggaaaagtgggactcagtggggctctgtgtctgctctaggcctcggcagaggagagcacagtcgtttggagaggagacttggtacaaataaatgtcaccctccccaaaccattaacagtcatatcctcaacaattcccccaacactttgcagcttgcaaagcctttttctcaatggttatttcagctaatcttcacaacagcctcgagaatgagtagacgttattgttcagtcaattttatagatgatgcaactgaagatcaaggatgttggctgattcaatcaaggtgactcagccagggagcactagagctggcattcaaacttgtgaagctcagactcggagctccacaagcctcccttgccttgtccactgacttgcctcagcctaaatgtcacttctgcagagagctctttgtgactgccaaacccacgttaggtcccctttccatgattctcattaaaatggcaccaggtctttttaattcatagtgacaaaaattcataatttttgtcacagtggtcatctacttaccttgtgatgacttagttaatgcctgatttccaccctaaactgtgaccaccatggggaaaggatctggtctctctggtccaatgctgtgtatcccagtggggcatagtgtctggaacaccgagagcactcagaaaatatttgtgtaatgagtgatggtagcccctgctcttctctgaacttcaatgtccctaacagtggaacaaggtggttggacttcctgagggtccttctaaatcttttatgctgtgacccagagggtctccctaacttaggactttatgaagaagatatcaaaattctctgagattaattaagtctagccagtggcatgagccaatcttaatgtgaacaaattttgcaattgcagttagatttcttatagtgtatccgttagtttttcctgcataacaaacacctcaaaacttagtggcttaaaacaacaaatgtttatctggttaatgattttgtgggtcagcagtttaactgagttcagttgggtggttcttctggccttgcttaggatcactttagcagcagcaatacattgccagatcagcagtgggctggttggtatgggaggctcacctgtgttccacatggtctctcagcttccagcaggctagctccaggttgttcacatggtaggagaagggttcccagagcagcaagagcagaaattgcaagatttcttgaggtccaggcttgaaataaacacacatctacttccaacacattctattggtcaaagccagtcacaggaccagcctagatcaaggaatggagaaatagcctctacctcttgatgggaaaggctgcaaaatattgtggcctttttacaaactaccacatgtaggaaacatatgggatatgattcatgatgattttgttgaaaaataacttagacttttctggtacctatagctccttgcagctcagtgggaccctactagcttctagacttgaatgatgaaagttctatatatttccttcctcttttccctggagtgcttcttgaactcacaacgcgagcgcgcgcgcacacacacacacacacacacatacacacatacacgtgaacaccctctcacaatgtgttgtctcatcaactgcaagaattgtattgtccaaattactggattaaggattgacatcaacatttgggtaaaatgaagccctcacagccactagaggattcagaggataaacactctaaatggcttaaaatatgttttataaatacagttaaatacaaggttcacccaatcagtaaatgtttattggacacctgttatatgcaaggctgtgaatatcagtgggaagccatttctggaaaacatttgcttccagaacatccaatcaatatatgtatatatttttgagatggagtctcactgtcacccaggctggagtgcagtagcttgatctcggctcactgcaacctccacctcctgggttcaagtgattctccagcctcagcctcccgagtagctgggattacaggtgcctgccaccacacccagctgatttgtgtgtgtgtgtatttttagttgagacagggtttcaccatgttggccaggctggtcttgaactcctgaccttaagtgatccgcccacctcggcctcccaaagtggtgggattacaggcgtgagtcactatgtctggcccagaacattcaaatcgtattacaaatttgttctttaatgtaacacttctcctgagatgccatcttctttacttagaaaccgcagctgagacagaggttcccctagggtatgtattagctgactgtgtccctttttgaaaactttcaccgccgctctacgggcttgaagtgtttttttttgcaaatacattctccattgtttggtttttgcaagactccacataaattttcccatagctgctttagcttctacaaatgatcacactccctctccctccttggaccttgggttacttttgtaccagacttgccggggtggcctgagaatgagatataattctcagatagggctgtgtccccatcagcagctccaggggggtagaggacctggtagaggtcagttctttcctgttgagagcagactctgtccaggagttacagaaatggatatttcctgatgatgtgacccagaaagagtctcctccttcctgggacgaggtgaggaggaaagggaagtgggcttgggactcagcagacctggattcaaattccagctcctccatgcctcagcatgggccagatttccttatgcaagtgatagcagcttcctatcaaatgggaggagtagcagcgtctgcctcctagagtgtcatgagaagtaaatgaggtgtgtgtgtattgtggattctgttgctgcctcaccagagtcctgctcatcattcagctgctgtgagtgttggctgctaactattcacagctactctttctttggaaaattggaactgtgaacccaggagaggatagaaggggaggtctagaaaccgatatccttatctcaaggagtgaccaactctgcaactcctcatgggctccagctaatccagccagactccagccaccaaggccaaatctttactcagctcctcccctgtcatgtcctgcctccctcccgcccttcttctaagagccctcttcaagtcactttcacaggcatccccatctcaggctgtacttcagaggaagctaaactaagagtatgtaaagaaccagagtcagaaaaactagctatgacttattattttttaccatatataatgctttggtcacacaagagcttctgttcacctcttgcgctcatttacaacttggtgtttttgtatgcattgtttcctctgatgggaatcccctagtgtttttcaaccaacaaatgcctatttgttccttcaggggcactgcaaatgtcacctcctcatcacagccttcctggctgtgtgtagagttttccactctcttagctctaaataccacttctgctaaagagctcacattttttacaggaattattgaaagaacttgtgtgtgtgtgtgtgtgtgtgtgtgtgtgtgtgtattagagtcagactgaatgacatgaatgacatcagatttgcagtcttaaaagctctcaatgacaagaatgaatacagggagaccaagttgagagggttggtaataggccaagtaaaggatcaagatctagattgtggcagaggggatggaaagaagtagatgcattggagataaagttagtgggtcttgacagtgatggacatagagggagagagaaacggaggggtaaaggatgactcctaggcttctaccatgagcccattttcaggcatggtggtaccattttctgagttggggaaaccctggggatttgcaggtttgatgatgccagacttggatgtgttatatttgagatgctcatccacatggagatgttcaagtagatagatgatggtacaaatcttgagctcataagagaagtaaatttggaaatcttcagcccatgatatcaaaaccttgggagtgaaggagatttatggagagagggaagaacgagaagagcagaggaccaatgactctgagatgttgagctccaacatttgaaggcaaagtagaggaggagaagactgtgaaatagattaagaaggagtggtttgagaagtaggaggagaacttggagtcttagaaaccacgggcagagtaattcaagaagagaggggatctaggtgaaaaggatgttggatccacagttccttaaaatttatcaaaggataaataaaatcctttgataatgggatcacatcaagttaaaacacttctgtacagcaaaggaaacaatcaacaaagtgaagagacagcccacagaatgggagaaagtatttgcaaactacctgatgagattagtaatcaggatatataaggagctcaaatgactctataggaaaaaaaatctcgtaatccaattaaaaaatgggccaaagatttgaatagacatttcttaaaagaagacctgcaatggcaaagaggcatatgaaaagttgctcaatatcactgacaatcagagaaatgcaaatcaaaactacaatgaaatgtgatctcacccagttaaaatggcttatattcaaaagacaggcaataacgaatgctggtgaggatatggagaaaagggaaccctcgtacactgttggtgggaatgtaaaatagtataactactgtggagaacagtttggaggttcctcaaaaaactaaaaatagagctaccatatgatccagcaatccaactgctgggtatataccccaaagaaaggaaatcagtatattgaagatatcggcacttccatgtttgttgcagcactgttcacaaagctaaaacttggaagaaacctaagtgtccatcaacagatgaatgggtaaagagaatgtggtatttatacacaatggagtattattcagccatacaaagagaatgagatccatttgcaacaacatggatggaactagagatcatcatgttaagtgaaataagccaggcacagaaagataaacattgcatgttctcacttatctgtggggtctaaaaatcaagacaatgaacccatggagatagggagtagaaggatggttaccagaggctgggaagggtagtggggcagaggggggacatggggatgattaatgtgtacaaaatagaatgaataagatttaatgtttgatagtacaacaaagtatagtcaataattgcgtattttaaaataactgaaagagtataattgggttgtttgtgacacaaggataaatgcttaagggaatggataacccattctccatgatgtaattattacttattgcatgcctgtatcaaaatgtctcatgtactctataaatatgtacacctatgtacacacaaaaattaaaaataaaaaatgatttgataaatgttaaatcaaacatttaaacatactcaagggaaccataaaggcaccagcaaaacaaaccttaaggtatactttacaagtttggtgtggggaaggcatttctactatttaaagcctcagaagaaaagacttaaaattggaccataaattaacataaaactaaattaatataaatataaaaattaacataaaatcaacatatgacttttgtatggccaaaccagcataagtaaagtcagtagacaaaagttgggcaagaatattttcaacttacaccatagttgaagaactaatcacccttatacatgaagacttgctagagatcagttcaaaaccctggtagaaaaaaaggaaggagatatgaaccaatagtttacagaaaaagaaatacaagtggctcttaagtatgtgaaaagtgctaagaatcattcataaatcataagacagccattttttaccaattggattgaccaaaatccaaaggtttgataacacactcggttggagttcttatggggaaacaggtactttatacatttctgtgggcagggtaaatggacaacatctatcaaaattgcaaatacattgacctttaacccagcaattcgtttttttggaaatatgccctacagatatatttgtacatatgagaaatgacatattcaagactattcattttgatattgctttactaaaaaagatgtaaaacagtacagtatgctaccatttatacaaaaaggtgataagaatgtatatttctaagtgcttgcatttgattaaataaccttggaaggatacatggacgctagagtggctttgcgcgttgtacatgcatgtacctctgtgtgtgtgtgcgtggtatgggaactgtgcaggtgctgggcagggatagaaaaagacttttcaccgtatctttttatgtttagggagttttaaaccatgggaatttattataactttagaaagttaaataaaatgtaagaagaaggagagagtcagttagctcaaacacttctgagggattgggtgagatgaaagttgaaatgtgtccagtcatcttagcgaaaaggaagtgactctgggcttcagtataagcagttttgatgtgcagggtcattgttctggtcccatgggcagattgagaagcgtgaggtgaggacatgtaaacagtaaatatagacaacttgtgtgagaaatttagctgtgcaggacaagggccagggccgagctcaatgagatgaagattccatagaagggattttcttttttttttttttttaaagaaaagtctttagaatatttagtcatcaatggaaagtgtcaggagagagggtgaagctctgggtttaggagggggaaaggctaagggatgctttcagatttcagagaaagtgggagggtctggatcctgctcagaggtggtggctctggccttagctgggagtgctgggtgtggaggacagcagagaaaaggagtgtggctttgtagatgggttggctgggagcagagggtgtctgcacctgaaggtgtcagtcttctcagagagttggtgggccaagagccaggggactgcgggtgagaggtggtggggaggtctggggtatttgctgtggggcatgggagaatgagctcccggtgcttgtgctgtggggcagacaggtgggttaatccagggcaagagatctgccaggcagttgcaccagaaggacacaacagcttttttttactcaaaagagactaatgtaaaggatcagggaatctaagctgcttttagagagaagacgggtcccagggcctggggtccagtgcagctaaagagctagtggggagcagctggatggcaaggacaccttattcagagtgggacgctggctggtgattttggaagtgagcaggccatggcattggcaggggcctggtatgcctggggagcagggagctgcatgggggagaagctcctgggaggtgaggagcccactgcccagcacagcatggtggctgagctgaagggccctggaaggatgccggggtagggtggatgggaaggtgggacccagaactgaaggctggaagaatgaggggctggatgctgatggggctgggtgtgatgggatttatagggacaatcagcaggggtctgaatggatggggcagtggagagggagaaggatgtcagttcctctgaaattcctgttgaggcaggaggcaagcagaaggcgtgttctaaggcaaggctgggaaatagggtactttgttcctagagtgagaatcccagtggctccagagctgtttgcaaggggaatgacactgcacaattgaacataaagattctggggacttacacatgaggtgctccctggggagctctcaggtctctggggtgcggtgtgtgccaccaaatgtgaacctgctggctgtgagcctcacagggcatgcgcagcacccagtgtggcccctggccccactgcccctgtagcatcccttcccgatgctccagcagaacgtgtgctggagtacagccatcatgtcatacaggccaacatcctcatgctacagaatgaggcttctcagtgcctcacaccacacctggcatgcaacagacacacaagaacttggagttcgtgattcttgctcttggttccagcaccaccatcatgtttgtgcagcaaccttccttcacagatccccaagtttgcctggtctgtttctctcaccacttggatcaagcatctccccactagggtggggagatggtaccatcaggaggccagaagacaaggtgctgttcagcttctagaggagaactcagacctgccgctccctgagcactgaggtccttgcggcctcaaagtcacagcctccttccagcagggggcagtgtcagatgcccagaatgggaaaaagagccaggagctctgagttcgaggctccgccctgctcttaggccttcacctgtgctggtatcactctgaacctgtttcctcatgtgaataatgagggtagatggtctgttttttccagcactaaatgatgataccgatgatcaataacatttgccctgcacctccttaggctcaggctcaggggctaaatgttttccatgggtggtctcatttcatcctcacattaactgtgtaggtgggcactattgctgtcccattttacagaggaggaaactgcagcacagagaggcagaggagggtgaggctcttcgaaacaaataaaaaccctccccagtaaatgtattggaggcaggcgaccctcctgctgctgttgaaatctaagatttctgtcttagtaattctggcctctgagtctgtgtacactgtaaagggcaaagatgacaaggcttttattgctttaattaaaacctgggtgaagagctcgcgattcatattaaaatgaaattgtgtttcacccgctgtggtgcggagaaggtaacagcggtgattactgctaagattacaaacaatcaaagagaaaaggccttttgcaagcatttcctattaaagccacaaacatcacactttaaaaataattatggttgtgttatcagaacatgattcatgagttctgaataaataccagaggccttaaaggaaactgtttcaagaccatagattttgttcaaatctgatgaaatttaatatcacttcacagttggagaataaaatacaaggagggggaaaaagcccatcctgtgtatatggagagaattgagtatatatgtcagattgaactaatgagctcttccccatcaaccctaaacacatactcagaaaaaatggcctagcttctcttattttcactgagagaaaactgccgaggaggagtgagtacttatatctcaccaatcttaattttacatcccaatggccaaaaatatatttattttaaagctcttgattcctgcctatgagacgtttaaatatttgagggcgcaggcatggagacattggggaatggatggggggaggactttggtctgcatttatggtgcctcccctgtcataaagatatttttcatacaatgcagtgaatgtttatggcatatagttttgtttccttccaactattatgagagaaattgaatcccaggaaatgttcactctctctaaatgggatggaaacaatgatgatgatgtgggaagtgcaggggcctgggggaggggatagcagtggggtggacacgtgatttcaaggattttcttaaaaacagcacccttccccctcccagccacctcccagccacctcgaacttagcatcccctgtaggacctgagtttttactggggagggtcagagaatgaagattttatacattgttcattgctgtgtgtgagctcactggtgaccaagaagtggaaatgaagccagacgtggggactttctcagaatgggactgggttcttatcttctggagggtcaggatcctggttccggcccctcctcagcctctctccctgtgtcccctcagactggtcatttgtcctctctgggctctggtttttgcatctgtgaatggggattggatgaatatctctgagggaccttccgggttgacttacagccaagggctcagcccccttcacccactgcctgagcgcccaggagggacaatggtctgtcccagaggtcttccccacctggctgagtcacaccaatgctgagagggccccgcaatgaggctggaagctgtgtgtcacatttcagcccaccaggcatgatgataaggagctgggttataaaggtaatgacatgagaaggcagaactgggctcaaatgataatcttgacacatgtggctggggaagcttggacaagttaaccaagttttctgagcttcaattttgtctttagaagttcctcagagtgatgcagaagtaaattaagtgtgtttatatccaaagtggttattctagtgcttggtacatagcaattggtagttagcctgaggtgctactaaaatccccattttatagatggaaaacattattttcagtaaggtaaaatgggacaggtacatactcagccccaagtagaggcccggaagccctggggtcaggccagtgatgcaggccttcgaagatgcatctgcttgcgaggtagcagggtctgtgccaacagccacccggtggcgccgagctcatagttgggagggtgcttagagcagagtgaggagctggggcgcatggctttaagaggagtgtgtgtccagctgggaaggatgagcaggcggtgagagtgacccatgcacttggagagagagatggggaaggagggctctgaggaaggttgctgtgcattgggaggtgggatcttcctcttataagtcccctgaagaaaaccttcagtgaagttctttgtaactgcccaaaggctttaaaagttagcacagtgtgacctttggctattgactgctgggatggccctcaagggtgggaagtttgtggctagtggttatacttgtgccatgtgtaaactgagcagttgtagttttattgttgccactagccttcataaacaatggttggcaattgcaacaggaaagatataatgggaagggacgaggaagccttttaaaatgtatgtatgtatgtatgtatgtatgtatgtgtgtattttttgagatggagtctcactctgtcacccaggctggagtacagtggtgtgatcttggctcactgcaacctccgcctcctgggttcaagtgattctcctgtctcagcctcccgagtagctgggattacaggcatgtgccatcatgcccagctaatttttgtatttttagtagaaatggggtttttccatgttggccaggctggtctcgaactcctgacctcaagtgatctgcccaccccagcctcccaaagtgctgggattacaggtgtgagccactgtgcccggctttaaaatttattaacatggtatactcccaccgaaacggagaatatgtaaaagactaagttgagaaggatctggaggaaccagtaccctcactcactgctgtgtaaattggtaccaccatagatgccattttgcagtatctaaagctgaatatatgtctctatgactcagtaattcaactccacaaatgccttcgtatgttcaggccaggcgtggtggctcatgcctgtaatcctagcactttgggagtctgaggtgggaggatcgcttgagcccaggagttcaagaccagcctgagcaatttagtgagacccctgttttaaaaaattaaataattagccaggtgtgctggtacatacctgtagtcccagctactcgagaggctaaggtgggacgatcacttgagccctggaggttgaggctgcaatgagccatgtttgctccattgcactctagccttggtgacagagtgagactgtttcttaaaaaaaagtttataggagtgtttttcattaaagctcaaaactgaaaacaatccaaatgcccatcaagagtagactggatacatgattctgaaatattcttacacagtggaatactatgcagcaatgagaatgaatgatgtgtaaccacatgccatcaagcagatgagtctcacaaacacgttgagtgaaagaaaccagacaacaagacagaacattctagacaatgccatttacatacagcacatgaacaggcaaaactaatcaatggagatagaatgtgaattgcagttaccctagaggggggtggggagtgactataggggctttgaggggcttcagaggtgctgggaaggttttctcccttcctttgagtgctgtttacacaaatctgttcactttatgaaaattcattgagctgtacatttatgatttgtgcacttttctgttgtattctatgcttcaataaggtgtaaaaaaagaaagatcaaggcattgtatttttacaagtatctcaatttttagagacagggcaggcagggaagggaacctagccaggtttggtcatttgtatcttgtgttaatccggtcaccagggtagtaaattcccactgagagcatggatgggcgagccttttaccgcttgaacaatgtatttaacttcctgggagggaaagaattattttagcctcataatggatgatgagctgtgaaattgctctggctgtggcttgccccagggaagcaggtggcacgggcttccccagatctgctcagctctgcaggctctggccttccacttctatttccttgtggacagagttttaggaaatgtttgaaatatcaacatctttttttttttttttttttttttttggagacagtgtctcactctgtcgccaggctggagtgcagtatcacaatcttggctcactgcaacctccacctccccggttcaagtgagtctcctgcctcagcctcctgagtagcggggattacaggcacatgctaccacacccagctaatttttgtatttttattagagacggggctttaccatgttggccaagatggtcttgatctcttgacctcgtgatctgcccgcctcggcctcccaaagtgctgggattacaggcgtgagccaccgcacctggccgaaacatcaacacttaaagcacatgcatatgtgtgtgtgtgtatgtgtggtttttgtgatgctgtgctgtggtgccagaaaatcttgttaatggaatatgtgaagatgtctaagtttctctgggcacagacaacacacatgcttgtgtacagacacattcatgcacaaatataagcaaatacaaacacaacttgtaggcatgctcagtgtatggaaaggcacattgagcattgctgtgtgctcctgggcaagttactcaatctctcattgcctcagtttctgcagtgaaatggagataataaatcacctgactcttgggctagtgtgagcaatactctcacatgtgcacaagcacacacaaatgagattttagtttccgtttatttgcttaatggctgctttcctcctagactgtgggtttcgtgggggcagggacctggcacagggtaggagtggagttggtatctggtgagctaatatctggtgatgaacaactctcacaagcctactggtacacatgctgtttagacacattcacaagcacatctgacacacttattcacaggtgtaggcacatacagggatatacacacacacactcaaatgtgtccagactcagaacttaggagggtggatttatctgcagtttggggactctggactagaagtgagaacactgggttttggttgtggctccaggtaactctaatttattatgtgaccttgagtaagtctctcttctcagaggtcaaggactcccagctgcatgtgatggactggaatttgaaccacagttagtctgagtcaaagtgcttttaatgattcaggccgtgctatccccagtgtggtcatggacatgcagcatcccctggagcttgttaggcatgcagcatctcagtccccacccagaatctgatttagagtctcctaaatcagaatcttcattttaacagatccctacttgatttgtgtgcacattacagattgagaagtgctggcctagtgtactttgccttccccaagcactgcaagcaattagcccatgctgagggggttcataagctggtggggcacaggcacatgcctaccctgaggagcagttagagaatgggagaggaggcagtcgggagctgcctataaagacagaatcaacatggaagctcagcatcacacatgcgggagcccagtcccttctatttataaagaagcagaatcacacagtcgttaagagtgccaattcatgagctaggctttttaattttaaaaacagcatatattagggctaggcacagtggctcatgcctgtaatcctagcactttgggaggcccagacaggtgggtcacttgaggtcaggagttcgagaccagcctggccaacatggagaaactccatctctactaaaaatacaaaaattagctgggcatggtggcatgtgtctgtaatcccagctactcaggaggctgaggctggagaatcacttgaatccgggaggtggaggttacagtgaggcgagatcacgccactgaactccagcctgggcaacagagcaagactctgtctcagaaaaaaaaaaaaaaaacccacccagcatatattaatcatctcatagttactgcatgccaggaatcaagtgtggcttcatgtggtgcctctggcttaagatctcttggaggctgtgctcaatgtgatactcaaggctgtggtctcatctgatggcttgactgaagggggatttacttccaagttccctctattggttgttggccggattcagttcccctgaactgaaccattgagttggaatcatggctccatcccttcttaccagttgtgtggctttatgcaagcttcccatctctgtggctcctctgtgaaatgattataataataacacctgcctcatagagttgttgtgaagattaacaaattcatgtatgaaaagtacataggataaggatacctctacacatggtaagtgctatataaatggtttctgctattttttgaaaaaagctatagaaaagcaggtcagaacaatgtgactatgggggctgagctatatattttttaaaaattttactggtaactccgtaggttgcagcacaagcctagttcagagtggatgcttactacattttaggggagtggatgagctctgggtggcagccccctgatgggatgtttggggcatagttacaggagcacggggtccaggctgcaagaggagcaggccttgctctattctgcccagatcactgggccccatttgtggtgccaccacctgggaaggcagtagggtattgtggaagtcctctcaatgtcacctgggaggacaatggcatgagcagaggggccagcacacctaggtgataccacagaatgcagtgtttgggggctacagtgagttcactgtggctagtatcaggcaaggttgcaggacttggtccaggaggccttggatgccaagcagaggccgggaccctgttctgaagggtctgagcagggcagtgtccatggagcagtgtgctctaggggacttcactgctcagcctggtgtcctgggatctcggggcactcatgaggaccattctcagagaacttaagtgccttcatccacaggcagctggcgtgtggcacatttttaggcaatgctacttctgtcattttcagaaggtagaaatgggaaagaaaaaaaaagctgcaaatagacatcatttttccagaagcttattttaagacagaaacaactagagagcctactcatcatttttgctgcttttaaaatcagcactgccttgtgtgtgcctgggtacctgcatacaaggagcacaggcatgaattgaatttgatttttaaaatcccttgatccaattgcctctttttacagttggtgtaactgaggcccagaaaggggtcagtgatttgtccaaggtcacacagcctgtcagaggtaggggctcagatcttcatgagaagatgctaagataaggacaaggaaccaggagaccccgatgggccaagttagaatgatttcatgctgaacagcgtcactgagcgggctgcttcagacctttgctgacttcttagagcttgcaggaaagatggtgcagcactgagcccaatgccatagcagaccattaggatgttcattcattcattcactccaaaacatatttactaagcacctactgtgcgtcaggcagtggtgtaggtgctgagacgaaactgtgaacaaagcagtcaaacactcctagtccttactcgttcatgcatccttttattcagtaaatgtttattgagggcctactatgtgcaaggtactatccttggcccttggaatatatcagtgaccaaatggtggaatttatatcctagtgaaggggacaggcaataatcattattattattattattattattattattattattattattattttgagttggagtcttgctctgtcatccaggctggagtgcagtggtacaatctcagctcactgcaacctccacctcccaggttcaagcaattctgctgcttcagcctcctgagtagctgggattacaggcatacaccactatgcccggatcatttttgtatttttagtacagatggggtttcaccatgttggcaacgctggtcttgaactcctgacctcaggtggtctggcctcccaaagtgctaggattacagacgtgagccactgcagccagccataatcattattttaaagaagtaaagtatactgtatgtttgcaggtaaaagttctgtggggaaactgagcaggtaggggagctgggtgtgccagcaggagctgcacttgcaaacagggtggccagggaaggcgctgctgagaaagtgacatttgagcaacgacttgaaggggcgagggagttgagatctgggaaaggacattgcagtagagggaacagccagcaccaaggccccgcagtgggagtgtgcctggcatgtttgaggaacgtggctggagtggaggcagtgaggtggaagaactgggagacttatctgatcgacggctgggatggtcaagagcagctcccaaccacgtgtggcatgggcagaggtaagtgacccaggacagcatcaggagtgatcgtgtaggagcgatcgtgtaggagccaggatacccctacctcccttgtaaggcctcccagcattgacatgagggcagggcacgtgcatggggtgtggcatcccttgcagtgatttaaagggaagtctcagcatctcgcaatgtcttggagccaaaggagctcccattttgaggccactgtgggaaactcatgtggcgtaaggaaggatcatagccttcagatcgagccaggcccatatctgaaaaaatgtcgtggttgaatgtcttagtaataccagcatggagaagccattttctaagcatgatgtgaaagccagaaatcatacattaatacatttaatgttttaacataaatgtaaagcccttgatatggcaaaagttataaataagatcaagtgacaaattgggagtaatatttgtagcatgtaacatgcaaacacatagaataaaacaatagaaaaatggcagaggtaatgctggttttagaacatgaaacacattcgtgtagggtttacaaaaaaaaaaaaaaaaagaaaaaatggtggagggccagatttggtccacggcctgtgatttgctgatccgaactgatttaggaatgttgacatgtccaaaactgagctcgtggtcctccttatacccaccaagcatgttttcccctcagtattcctccaccagtggctcgagatgggaacctgggagtgatgttcgagtccccgctgaatgaggaaggcacgtggcatgtcagacaccatccaggctggccatagcgatgagggggtgtcataggaggtgagactggaaggagactgggccggatcatgcaggactttgcaggctacagagagggtttcacacacactgtatcctgagcgtagaggacatcagctaatgggagtatcaccatcagttttgtgtgtggaacctctaccctggctgctatggagaacaatttggaaggaaagagattagaagttaggagatcattgaggaggtgattacagcagtccttgtgggaggtgatgaccgcttggactaggatggttgctctgcagatggattgtggtgggaagatttgagatacatggggaggtggggctgacaggactttgtgattgattggagatggggatgagagagggaggaattgaacatctctcccaggtacccagcttgagccaccggtagaggaatactgagggggaaatggacttggtgggtacaaggatgaccacaagctcagttctggacgtgtcaaagaaatcatggcccttggaccaaatctgaccctccacctgttttgtgtaaataaagctttactggaacatgggatcctcctaagtttaaatattgcctgtggctactttcatgctatagcaatagagttgaatagttctgacagagaccatatgactcacaaagccaaaaatacatattatctgcagaaaaagtttgctgggcttttgtgtaggacatccaagggaagtaaagtatcaaagaggcagttggatatgtagctataaaaatgtaatttgaggctgggcacagtagctcacgcgtgtaatcccagcacttcggaatggaaagcagggaggattgcttgaggccaggagtttgagaccagtctgggcaatatagcaagacccggtctctacaaaaaaataaaaaatagtaggacatggtggcacacgcctgtagtcccagctccttgggtgtctcaggtggaagatcgcttgaatccgggagattgaggctgcagtgagctgtgatcatgccactgtgctccagcctgggcaacagagcaagaccctgtctcgaaaaagaaaattcaattaaaaaaacaaaaacagtttggcacggtggctcatgcctatactcccagcactttgggaggccaaggtgggtagatcgcttgagctcaggagtttgagaccagcctgggcagcatggcaaaaacccatctctacaaaaaaaattaaccaggtgtgttggctcgtgcctgtagtcccagctattcaggaggctgaggtgggaggatagcttgagcccaggagtcagaggctgcagtgagccaagatcatgctattgcactctagcctgggtgacagagccagaccctgtctccaaaaaaaaaaaaaaagactaccacttattggaaaactgagcttccttatctgtaaaatggggccagtgcctgcttcaggctgcctcttctcattcagatgctgttgcccacaagttatccccagccttgcgacttttgctacttaagttctgctgggactgctgcttcctaaagaaaaggacccccaaacccacccaccaatcatgtatctttccagagcctccccgtccctgcccggtgaatcacccaggatgctgctgaaaccttagcttgagtcagattgtgtcctgagcgagaacacatggggattatcatgtttgttcccagatagggttttagtcaacaaaactcctgtctaatgtgactgcctgtcattgtcccactatgatgcctctgtctgccctgatccaagcatttcggggtcaggaacagccacagagcagccgtggctggcagcgtggcacactgccggtgggagggtgttagatgcactcctgtgtgagtggcctggctcggcttggaggttctgcctgtagataaaggctgagaaaagatattacattcccctcccccacctcctccagaatccacgcttcattttaccggtatggcttttctctcctgtttggcttatatatggtatggacttttagttttttattttttaagaagcatttttagtccaggaaaatgacaggccaagcaaaaggcataattgtcctgattttcagaagtgctacaatactccagatctgatgtatggtgagactcgaatcagaaagattctattaaacatgtctggggtgggtgacataggggtattatctgagatgattaatttgactcggtcattatggacacagacaagcctgacaaaattgcatttcattccccgcagaattcataaaatcactatacccgtgataagaagttacagtgctaggagctcagctccagttgttggggtttggagttttgataagatgtcattttctgttgtgaaaacagagttgagaaacactgaatcgcactacagtcttttagcagagatggctttttttaaacttttattttaggttcaggggtacgtgtgaaggtttgttatataggtaagcttgtgtcgtggggatttgatgtacggattattttgtcacccaggtattcagcctagtacccattagttattttttctgctcctctccctcctcccaccctcaagtagaacccagtgtctgtttttccttttcttgtgttgatgagttcttatcacttagctctcacttgtgagtgagaacatgtggtatttgcttttctgttcctgcattagtttactaaggataatggcctccagctccatccatgttcctacagaagacatgatgtcattcttttttatgactgcatagtattccatggtgtatatgtaccacatacaacattttctttatccaatctgtccttgatggtcattcaggttgattccatgtttgttgtgaatagtcctgcaatgaacatttgtgtacacatgtctttatggaagaatgatttatattcttctgggtatatatccagtaatgggattgctgggttgaatggtagttctgctttttgttctttgagtgattgctatattgctttccacaatggttgaactaatttacactcctaccaacagtgtaagtgttaccttttctctgcaaccttgccaggatctgttattttttggctttttcataatagctattctgactggtgtgagatggtatctcattatggttttgatttgcatttctctaatgatcggtgatgttgtagctgagatgttcttgctggtgcgggttttacttgttaaaatggcaagatggtagggcgaccatataatttactggccaaaccaggacactgtttagagtgaaataaaacattattaacgtgacactggaacaagaggcgtggagcaggcctgccctggcctagccaggactcgtgtgtgttgggaggagcttgaacagtggcagagcaaagctttggctactggtaggcagggcttcttgtcctcattttcataaatgctacccatatgactttggataagtcatttttcccttttgaacctcagtttcctcatctgtaaaatggaaatgccattttctacttgttctgcatatcatccgagggctttttttttcttgcttgggtgtgtgtgtgtgggatttatgctgacttcctgttaatgtgttttcccatctgtttcctggtataattctctcagctcttaggtggggttttgtagacaaggaaactgagtagtaggcagtttggataaattgccagaagccctcagcaagtaagattccccatgtcagtgtaactccaaagccagagctctttctgcagatcaacaatgtaactctcaatacatgagagttacagcacctcatgtttccatgtatttcaaatattcctcccaacaaagctggaaggttgttggaatacataatcaggattcaactctggggacacaagttgggttctcccaagaatcatttctcaccatgcatcaccagggagtgaatgccacttctccttttatgctatactccaactctcaacaagctctttggaaaaaggtcaaatcacctgctactccctcagtgaatcttcacctctttcttatacagcattgtggtgggaaatggagatcgatagtcaaaatggcagcctgagaactttcatgtaagcactaactgggataaagtagaaagccatcactaataaaaggaacacttcaacaagcagatacaataacaactgatttgtaaatacctaacaacatagctttgaaatatatgaagcaatacagcaggttgataaaatcacaatcacagtggaaatttttaacacatttctctcagaaaccaaagggtcaagcagaaaaagaaaagtaattgttgtttggaagatttaaatgatagaattaacaagctgaaaattataaatattgatcaaaattagcctgatactgtatcaaaggaattctcaatggcttttaaagaattaatatatttttcattcccttttgggtatctttttcttttttcatgtcagtggttccttattttattagccttttcaaaaaaacaatctcttccttgtatttcttatctaaaatttgttttctattttatttttctcctacagactttcggtttattttgttattctatttctaccatcttgagttgagtgctgagtttgtctttcttgtcttctaataaattcattttgataaaagtataatttttcattgtccatctctcataagttttgtcaggtagtgttctcatcatttcagttgtgatttcctttttaacacagaagttacttagatgattgctcttaaagtgtttaagtatgtaggaggatttccctccctccatttttttttctgctcgtttgtttttgttaataactaggttggtgcatgtactagtctgttctcacattgctagaaaactacctgagactgggtagtttataaagaaaagaggtttaattgattcacagttctgcaggctctataggaggcatggctagggaggcctcaggaaacttacaatcatggtagaagggtgaaagggaagcaagcacatattcacatggcagcaggagacagggagatggggaaagggctacacactttcaaacaacccgatcttgtgagaacttacttactgtcacgagaacagcaagggggaaatcagcccccatgatccaatcaccttccaccaggcccctgcctgaactctgagaattacaatttgacatgagatttgggtggggatgcaaagccaaagcctatcagtgtagttaggtcttagaatttgatctatctaatttctaccttttgaagagtttgagattctctttgtagtttacctggttatattttgtaagtgttctatggacatttgaaaggaataaatcaaaagagtgaattgcgtcattcagatcctcaatcctcactcatttctatctgactgatttgcccattttatttatggttttatactaacagttttttacattttatatttctgtggttttatcaatttacataaaaatttgtcatttcttcttagtagatttatatcatttattgacttaagtgttccttttgatattttttagtgcttttttgccctgatttgtacttaatttgtaattaattttgccactctgctttttgttggcctgatacatctatctatctatctatctatctatctatctatctatctatctatctatttattttaagatggagtctcattctgttactcaggatggagggcagtggcacaatctcagctcactgcaacccctgcttcccgggttcaagggattctcctgtctcagcctcctgagtagctgggattacaggcactcgccaccatgtccagctaatttttgtatttttagtagagatggagtttcaccatattggccaggctcatcttggactcctgacctgaggtgatctacccaccttggcctctcaaagttctcggattacaggcgtgcgccaccatgctcggctggtgtctatttatttttatcttacaggtcattttattttaggcatgtctattataaaccatatgctgtatgtattttaataaaaatattttgtcttttaataaagcaattgaaatcattcgtattatgttatgaatatttagtcttaatgctgccattttatgaatattctttattatgtttgatagttcactcctgttttctttgcagatttttctagattgataaagttctgttttcttctactttctttggttcttccaatggtgtaaaatttttgcttttccttaaaattataacaaatatttaataaattaattcatcaaagtttcagggcaagatcagtatggaaaaatcactggtgtttctgtaaaccaacaatgaacaacccataaaggaaactaaaaaaaaattccatatataataacatctaagagaataaaatatgtaggaataaatttaaccaggaaggggaaaaactcctaaactgaaaactacacaacattgtcaaaagaaattaaagatctaaataaattgaaagatatccatgtctgtggattggaagacttaataatgttaagatggcaatactatctgagcgtctacagattcaatgcaatctttatcaaatttccactggtcttttttgcagaaatgaaaaatctgatcctcaaattcatatggaattgccagggggcctgaatagcaccagtaatcttgaaaaataacaggctggaggactcacacttcccaatttccataaagcaacagtagtcaaaacaatgtggtactggcataaggatagacatatagaccaatggaatagaattgagagtgtagaaataaaccaatacatctatggccagttgattttatataggggtgtcaagaccattcagtggggaaagaacagcaggctgtgtggatattgagagcagagtattctaaaggaagggaacagccattgcaaagactctggggcagaaacgtgcctggagtagctggagtggtatgaacaaggggaataggagatgatgacgtcagagaggtaaaaaaggacgtgggactggggagagcaagactacatagcatggggccgttgttccttatctgagtgagaaggagagctctagagggttgtgagcagagcttatattttagcaggataattctggccctggggtgagaatggaccttagcaaaggtggaggcagggaggccaagaggccagggaggagactgctgcagtcatccagggcaaagagggtgatggctcaaggtggagctgatggtatttttggacacatttcgtgtaggatgtgagaggaagagaggggtcaagggtgacaccttggtttctggcctgagcaaccagaaggatggagtggccattagctgaggtggagaagactgtgggaggggtaggttctctcttaaatgtgttaagttgtttgaggtatcaattaacatccaaagggaaggacaaataacagtgggctatatgagtcagcatttcaggggaaggtctggctcggtggtaagaactggagctcagcagcatacagatggtccataatgccatgagtctggatgagagcaccagggagtgagtgtgtttagaggagggtataagatctgagctctgggaatgtcatcatcaatagattaaggagaagaatgggaaccaacaaaggacatacagaatggcctgtgatgttggccatggacagaagaaatggcctgtgatgttgaaggaccaatatctctggtgtcccagaagccaagtgaagaagtttgttcccagggaggaggatgaactaattatatcaaattccactgataaggtcaagatgaaggccagatgaagactgagcattggccactggatttaggaagatggaggtcattgatgaccttcccaagcagttttggtggaagtgggatgaaaacatgattggagtgggtttaagaaagaacgagtggaaatgaagaggtaactctttgcagatttcctgtaagattttactaatatttttaactggcaaagctcttacgacttagcatctctttctatattttcatgaggatgccagtggtagagagaaaattaggcaccatggaacggccaattctactgtaggaaaatgctgggtttggagtcacaagaccagggtctgaatcacaaccaggacctactagctatgtgacacctctactctctaagctccatgtccctcatctgcaaaatgaagataataatcacttctctacagaacacatatgaactaaatggagaaggtacatggacatgctgggctcagtgcctggcacatagtaggtactcaggacaagttgtttagtgttcagtgtcatgcatgtaggatttgattgcattcagaagaggcatgttcatgtttgcgtgcttagttatttttaagtgtgctaattgcctctttaagtgaattgtcataattgtgtgattccaatattttgatacagcatatgcttattttttcaaaaggcttctggtcaattgggccggttccagtggattgaagttttgttttttgactgaaaggaatggacttgagcagtcagttagcattcactgggcaccttctctgtgccagcacctgctctgtgccagcacctattttaacagtgctgagggacagggagggaggtgtcggtcaaaacacatgaacagcaggtggctgaggggcgtgtagtatgctgggaaggagagctgtggtttgaaactagagcctgggacattcccccatttcccgtgcccatttattgtgttgtaatgagtcattactgtgcactgtgctaggcactgaggacaagagagttaaaggacttccccaaagacacagaataagtaaacagcagctcactggctcaggatcctcatttatgagtgttcctaactcacacagcacaggtctgagcaccacagggtgatgtgtgtcttcagcctgaccaccaagatgggctgggggccgattgcctttaggtggcaataagccacagatatcatatcaccccagaaagtagagtcccactgccagctttccagttcagagtcgccacctccaggaagccttcccaacccctctgcccattctaaggcaagactctactcctttgatgctccctatacaattccttgtgtgtgtcccccatagtatcataatattcatgaccacctgcaaccattttgactctacttaccttttgcttgtgtccctgtcccccatatcccagtgtgctactgtttgcttattctgtgtccttggggaagtccccaccatctctgaaactccagatgagggcagcaaggatagcaataactaacgctgacatcactcactgtgtgctcaacattgccctgagaaacttacatgttattgattcatttattctttatagcagccctgtagatacatactgtcattacctgctttctcacacatgaggaaactgaggcacagagagggtgttttagtctgttttgcattgctataaaggaatacttgagactagatcttttacaaagaaaagaggtttaattggctcatggttctgcaggctgtatcagcatggcacccacatctgctcagcttttgatgaggcctcaggaagcttttactcctgggagaaggtgaaggggggagcaggcatgtcacacggcaggagaatgagagagagagaggggaagaggtgccagtctctttaaacaaccagctcttgcatgaatgaatagagcaaaaactcactcattaccacagggagggtcccaagccactactgaaagatctgccccatgacccaaacacttttggctcagccccacctccaacagtgggtcacttttcaacatgagatttggaggggacaaatatccaaactgtatcagagggtaagtaatgcacccagagtcacacacaggcagtaagtggcagagccaggatgcaaacccaagctgcctggctcctaaccactgcactgcactgcctcctgcgtgatagggacagtagttcccagctccagggcaatcatgaaggttgagtgagatgcatgtttatggtgtccaccccaggacctggctgtacattcaactttttttttttttttttttttaagatgaggtctccctctgtcacccaggctggagtgcagtggcacaatcacagctcacttcagccttgacatcctgggctcaaatgatcctccacctcagcccccgaagtagctgggactacaggtgcatggccacacacccagtgaatttttgtatttttttttgtagagatggggtttcaccatgttgcccagagtggtctcaaactcctgggctcaagcgatcctcccgtcttggcctcccaaagtgctgggattataggccaactcattgtttctgagctcttactttgtgttccaactctgtgccaggtcctgactgaggcattggggatatagggagcaaaactcatgttaaatatcagacaaataatcacacaagaagtcagttaactacttataacgatgagtgcttccaaggaaaaattctgggcaatcttggggtgtgaaatggggtttgatctaccctggagtatcagggaagacatttaaacaaaacctattgtggagagatgagtaggaactaaccacgggagggacagtgtgtggcaggcggagtgcagcagagggaactgtgtaggggagagcccagaggcaggagaggtcactgtggttagaggggtggtggggccaggccatacaaggacttccagggctggatctgggactgtggacttcatcctgaaggcagtggggagctcatcatttgatgtgggattgacatcgtgtgatgatcatcttgacagagaccagtctggctacagaaagagaatagagcagcccgagtggccaatgaaaacggctggtaagaggtggtggtggcctggactaggatagtggcagtgggaaagaaacagattttaaagatattttggagacatttcattggatttgagagatgtcagggggtgagtcccaggttcgtggttctatgaacgggatggaaggtagtgtcacttgctgagatgtagaggacacagggacacggcaggggaaggggtattatgatcaacaaacgagaacattgactgggcatcgagaggctccgccctggagctcagatgagtgaccaaggctggaggggtaaatgtggcacttagatgagaatcgaaacccagactggttgaggtccacctggggaggcaatgtagggcaggaagagaggggagttcaggacagcctgaggaaccctagatgagaacagagaaggagaaggtgaagcaggaaggtggacatggtcatggcctgttcccagatgactgtttgcccatctatgagatcatcccactgcagccctgcagagggaggaaatgagcaaggggccatgtgggctctgggtcccagtggtgggtcccagggtggcaaggcacttaccctctcagtctgttctacgactgtaaagggtagtctagggctctcccccatggaatttaggtatcttgtgctttctgctgttgccacaggctgtacacacacccagctatccccgctgctcagtaacttcatccagcagacactcagggaattggccaccaccaaccaggtcctgtgccaggctcagtgaccttcactattttaacacacgcacttaaacaatacaatgatgctagaaggtgttatttcttacatgctattgtggtttaggtttccccccacctctatgcatatttcttgattgatttaagatttagcactgtaggtaacaatatatgttacgtagttatatagtctgaaagagctagaaggaagatattgaatgttcccaacacaaatgataaatgttcaagatgctggatatgccaattaccctgatctgatcgttatgcattatttgtatcaaaacatcactgtgtaccccataagtaagtaccattattttatgtccatttaaaaaatgaaagaaaaagtgtagaaaacatttacctttatatttaccaatgcctttgatatgcttcctctgttctggaacattctcaactattatctcctcagttctcccctgacctattattctctcactcttctccttccagaatgctgattgaacaggcatccattagacactcttactctgtccgctgtgcacataaactctctttcatatttcctttttgaccgtctatgccaaactctggataatttcttcagagtcatcttccagttgacacacctcttttctgctaggtctaatctgttccagagtgtagaaatggaagaatgactcctcaagctaaagtaaccttgttactaaaaccccaacaaagacagtatgagacaggaaaattataggccagtcacacttgtgaacctgatacaaaagtcctaaacaaaacatcagccaacaaaacccaacaatctatagaaagaataatatgtcatgaccaaatagggtttattccaggaatgcaagattgatctaccattagaaaaccaaattacatgtttactatgctaactgaattaaaggagaaaggtcatttgagcctgtcagtggatgcagggggaaagaatttgatacaattgaaaagccatgcatgattttaataaagccacacactttgacccaccaggaggtccctcagcttgcttaagaatacctcaaagaacctgtggcaaatggcatcctttgtggtgaaatattgagctctttaagataaggaaaaaggcccggatgtctgttctcaccatttctattcagcgttgtcctggaggttcctggacagtttggcgaggtgggaaaaaaaaaacaaggaaggactggaaaggaaggtgcacaggtgactcctggtttctagcttgcactcctgcaaggatgtttgtgccatttaccaagatgagaaagactgagaagccttgggctgagtgttgggagcacaagagaaaatggcctggcttccctggaaagatcaccaggcctggaatcaggatacttcagctccattcccaactcttcccccagccatggatggactgctttcctccctggacctgagtctctatctgtgaaatgggtgggcaggaaagatggatccaaggtggactgtgatggccagatctggtgggaaaccagagaggaacagggggagccggcccccattctccaggagggcaggcttctgtgtgcagagcctctggtgggaggaaacatctgtttggggatagggcaggagtctgaccgagttagggcaccgtcttgaccctctgccttgcagaaacatcatcccttctctcctttgccaaggggttgctatcgttattattgttgctgttattggtgctgttgggtatgttctgcggttgtaaggcactgacccccaccgacatgtctttttgatgttttagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacggtgagtccctatcgcctgctgcagttcctgctgatgacagcagggagggggttgagagggaagcagaagaatgttgatgctttgataagaactctctgctcatgggcagggtctgggtttacctggttgcttggagttggtaatcccatgctgggattacctggtagcatgggagtctgtgggacacggtgggtgggcatggagagaaatctaatatcagcacactgcttccttctggagctctgcgtacagtatctcggtattggtttgcattatttgttaatagtataatctcatttttattttttaacagttttattgaggtataatttatattccatacaattcacccatttaaagtatactacttaatgacttttcatatattgacagagttgtgtgaccattaacacgattgattttagaacatttcatcaccccataaagaaacactagctaggcacagtgttgtgtacctataatctcagctacttgggaggctaaatgggaggatcgcttgagcccaggagtcctgggctgtagtgccctatgcaaatcagttggctgcactagctttggcatcagtatggtgacctcctgggagaggggaaccactaggttgcttaaggaggggtaaactggccacggtcggaaacagagcaggtcaaaactcccatgctaaccagtagtgggattgtgcctgtgaaaaggcactgcactccgggcatcatggcaagaccctatcacgaaaagaaaagaaaaatgctctgttgccgggcatggtggctcacgcctataaccccagcactttgggagactgaggcaggaggatcacttgagtctaggagttcaagaccagccttggcaacatagcaagaccccgtctctacaaaacaaattagccaggtgtggtggcatgtacctgtagtcctagctacttaggaggctgaggtgggaggatcactcaagcccgggaggtcaaggctgtggtgacagagtgagaccctttctcaaaaaaacaacaggaagaaacatcatatttttggccatcactcccaatccaccccctgaaatcttcagccctaggcaaccactaattgactttctgtctctataaatttgtctgttctggacatttcatagaaatggagtcatataattaaaaaaaaattgtatcttgcttaagctgccagagaagagggtgattactgagttaaagttcatgggataggtaaaaatgtagcaggcagacaaaggcaagaaagaacctttcccaggttgggggaatatcaggtacaaaaggaggtggcaagggtgctcgtgccatgcttgggaatagcatgtggttcatgctttttattgggctggagaggaaggacctggagccaaggagagagaggagatgaaagagctcagcagggcctggatcataagggtcctgaatcccattctaaggagatatatatccttagaatggctgatttgaggccaggcatggtggctcacagctctaatcccagcactttgggaggctgaggcgggggatcacttgaggccaggagttcaagaccatcctggtcaacatggtgaaattctgtctctactaaaaatacaaaaattagccaggcatagtggcacacacctgtaataccagctactcagaaggttgaggcacgagaattgcttgaacctgggaggtaaaggttgcagtaagctgagatggtgccactgcactccagcctgggccacgcagcaagaccctgtctcaaaaaaaaaaaaataataatggctgatctgaaccatcaaaatctatagaaaaatggtagaacagtagagcattttttttataccacagaaaaatctccttaagggaattctattgcttcttctgaacaactgtgacttgtgtttatttttgctttttttcccttcacatttaatattacgtactagtcatgactcttacgttcatttttaagtgacagggaccaaactcaaacttatacaaaagagtatgaaatatccagggggtggatacagggtttcaggcatggttcaatccaggaaccccaccagtgtcacaaggcccatttccacacaacaggcttgatggctgctggcagccagcatcttccctgacatctctggcagagaggatgatgacagcatcgctggacagaccactatgtctaggaggaagcagttcactattttgtcagcttgagtcacacatacacctgtggcacaggaggaggcctgcttagttgattttcctagcagaatctcatggtttggggtggcttgtgtctacctctgccatgactgttcagaagccacagtcgaatttgtggcccaattctagcagacccctgggaccttaggacacggctttatagtcaaacgatctcaactgtattttgtttactcttcatttattaccaccaaacttccttgttcaaaaaagcggtgtcctctgtgtatttttataaggcacgtcacatttttttgtttgtttttgaagctaggtgggaaataaaaggagacaagaaagggaaggagggtgggaggaaaccaactcgagatccacatttcatagtgtttggttctcacgaaagagttcaatgaaaatggatgctccgtttctccagaaattttttcctcgtgggtccatcaataatgcaagtcctcagcttcctcttctctctctcaaacctagcgattcagactcacactgccatgtctggaatggttttaacccatttatgcctgaggttgcaattttttgaatttttgctatcagaccttggcaatgagcttgagcagtaggatataaataactcccacatgcttagcgtttcagtaatggaacactaggcataaatgggtttccagttcgttagaatgcttgtaccgtacttgcttactgggctcattttctagcagaaacctcactgctccggaccatccctgtttgggatttatggtaatacaaacaagagcagggccaggtgggcactttgtcatctgctatgagggctgtggtgcaggggtgagcatggctacagtttggggccactgtgttgccgcctttggtactggggtgaatggagacagtgtggggtggtggttggtcccagacaccagaattagatcctggcttcacctttgaagcctcggtttccttgtcttggaatcataatcgtacccacctgaggattgtgatgaagtgtatcggagataatgtatgtaaagtcttagcaaatgtctggcagagagtaaacattcaatgagcacttgctattattatttgtaataaaaacgaatttgactgtaactgaatggcagtgttttcccttaagtctcatttacctaaaggagcagactgcagacgccctcaggtacatttgtagggccacctgattataatagctctgataattacaaagcatgttatctttttgtcaaagatggccccctaattgcccctcctaggaaatgcttttgttgggctctgtccaaataggcacttgcagtcgttttccagattttctttaaaagtagctcatgtttaagaggcttcacaaattcagatagccttaattcttccattagactttgcaagggttcactgaattttatattttctctttatgtcatgaaagataagccaaactctattacccaggggagggcacccggaccaactgggaaaaccagataaggagatgtacatgcattgggactatctggtgaagagagacaagggactcttcaagacaagagtttttaaattcatctgaaccacaggacaaaggggcgtggctctgtgtgtgcgtgggcatacacgctacgtgggtgacgctggaattggtgttaacacctgctgggtttcaagcaccgtgcagagggctttcaaacgttttcttgcataatccccccaagaagcaaaccgagggataatgataatagtatcatgaagggatggagaccccaaggtggcagatgattatattagtgtctcatggctgttccaagagattgccaccaacttgggggcttaaaaaaacagagatttattctatcacacctccagaagtccagaagcagtctccttgggctgaaatcacggtgtcaggaggaactcactttccccagaggctgtcggggagaatccagcctcgcttctcctccggctcctgggggttgctggtcttccctggctcgtggctgcatcattctgatctctgcctccatcttcacatcgccttccctctgtcagcaaaactccctttgcccctcttctaaggacatttgtgatggcatttagggcatttggggataatctaggaaaatctcccatctcaagatccttaatcacatctgcaaagaccctcttttctaaatacagtaccatttacaggttccaaggattaggacctgatgtctttgggggacatttttcaacctaccacagtgatcctcagctgtgcgacagccttcattgagtgcccactaggtaccaggcattgttctaggcttgtgatctacaagatgcccttgagggactcctggtgcagatggagagaaggtgaaaagcctatttctaagactgtggtaaattctctaatagcatcagtgtgtggtgctctgtgcccggaagaggccccttagatgtggggttatcacttcctagaggaagtgtcccctgatgcagagtagattctataagtactttgtgaatgaattactgtcatgcagctcttaaacagcaaggccagaatgcaaacccagctctatcccctgccatccacctctcagttttaccagatggctgagggatggtgcggctgggctgcagggccacaggtggcacagaggatgcgctgatggccagggtgcttcaggcgttgtctgcacagatcgagatacactgaggatgtcatccctggagaggcgggcaaggccaaggcatttgacagccatctcataaatgccaaagcccccttggctctgatcccagaggccaccaattctttccggtcccctgccctggcctgttcagccttgcaggcgtgggtgggagttagctttctgctttgaaggtatggcagctagcaggagtcatgtacagtattggaatcgaaccccttttacaaaattaaatatgcttaaggcttctctctcaacttcagcgtcttaactgattaaacatttatttccaagacaaaaagagtcaatttagtatgaaagatatattttgccggtttaatttaaagtgctgcacctctgtctgaccctgattttcataactcaataattttatcctgtgttgattgtctcatttcgagagagatattgtatgtataaatcagtttctaaaatacccaaagaaactcgaagagtggaatttattaagctgcttctgttaagtctgaaatcatttattttggagtcgtccttgggaaatgtttgagcttatgctcctggcttacccaggagaggaattaccctgggagatgacagagttggacattcccagacaggttcctggggaacctgcatcttttgtgagaccagagaaactcctgggagagcctcgggcagatggaggctgggcccagccagaaatgaattctggcaaagctcccccgacagtagctatagattctgctgatcagggaaatgtgggtttttcctgcaccaagccctgtgggtccctggagttgtgtggtcttgctgtgggactcacttagtgcaggagaggtatgcagtgtcattcatgcattctcctcccagctttgactcctgtttgctatctttgggatcttggacaagttacttctctcccagcctcagttttcctatctatgaaatggggattgggatttcagctctggtgaactcacaaataggaaaatgggtagaattgttttgttagcagtgacatactagacaagtatatggatctgaagttcaatagtcctcccactaccaacgtcacacatatcactggcctaagggggctcaaatactatcaaatgcagtacttagtgctgcgtttcagattctttgtgttctaggtccccgtcccaaagcatcttgccaagataggcccttcatgctgcacacacagggctaggggctgtggcccagggtcccccaccccaagtgaagggcctttccatgctggtgccctggactaggctgttggggaaggggctgagctgtaccttagttgccacttgaccaccttgctttagagatggttcctgtgcccggagcctgggggcaggatttaaaacttggagtggggacttgatcctgggggcagggccttggacttagggacaagttctgggtattgactctgggaggtccttgatataccttggagtggggacttgatcctgggggcaagggccttggagttagggacagggtctgggtattgactctgggaggtgcttgatatacctcctaacacctcccccattttcttcctgttctgaactattcccctccaatctcctttctctctcctcttctcttccctaccactttcctcctccctgcagaaggcatggtctatccctgttggattctcacaagttgagacataggaataccctcccaagttgcagacacaaggaagaaagaccctcaacccttggtcctctggtcttctgaaacacagggggcagtagggaccccctagtccaacccattcatttcattactcttaatgcataacatttttggtttggtcttgtcttatgaatgtatcaattagcttttgctgtgtaacaaactaccccaatacctagtggcttaaaacaatgaattcttatgatttctcattatttggcaggtcagcgaggtagttgttttgatctggactgattcaggtgatttctgaggtccagcttaaagcctgcctgcagctgcttattctaggatggccttattgacattgcagtgcttggcccagggtcagctgacaccaaaggggaatgatttggccactctcatatctcgtgatgagaggtgtatgtctcaaggctgggcatcgtggctcgcctgtcatatcagtacttcgggaggccaagatgggcagatcacttgaggtcaggagttcaagaccagcctggccaacatagtgaaaccccatctctactaaaaatacaaaaattagctgggcatagtggcttgcgcctgtggtcctagctactcgggaagctgaagcaagagaatcacttggacccgggaagccaaggttgcagtgagccaagatcatgccacttgcactccagcgtgggtgacagagtgagactatctcaaaaaaaaaaaaaaaaaaaaaaaaaaaggaaaagagagatgtgtgtctctcatcacatggtggcctaggatcattcacatggtgatggacacagggtgcaagagagggtacaccccaatgtgcagtacttttcaaacctctgcacgcatcctatttgccctagcccattggccaaagcctgtcatgtggcaaatcccagagtaaggggtggagaaatagatcctacctcttgaagagagaaatggtagagtcgcatcatatgagggtgtgcacgcagagaggcaagaatgtgtagctaactttgtaacctaccatgatgacattttgggttttctctgtgcatttttggtttcttggcatacagtatcatctagtagtcaggtgtataggctatgtggtcaggctgacctaagttcaaaccccagctcccctccttgttacccccaaccctgtgacccagatcaaggggttgatcctccctgagcctcagtttcttcatctgtaaatggagatattgttacctgcctcataggagtttataaagagtcagcgatccgatgcaggtgaagtgtcacgcataggcaattggtaaatgtaagctgctctgtttattactttaaccactttattgacggggttggggtggcttcagcctcgtctctaagtttgtccgggctgacctgctgcttaccaactttgtcgggggctgaggtggccagggatagtgggagggccccagctgggggacaggcaggggaaggcatattagttacacttaggacctcggtcagggctcagagcttaaaagcaacagcggagtgacagttccactgcttgccaagaaagcgggggcccaagacgcaatgcttcttggcatcgtgaccaagggaaggatccatcttagtcgaagcagggggttaccaggggcacctccgagttgggcttttccaaggtgccatgcttttgtctaacgtccctctggggatggaagtagggggagcactgatctcccaaatgggtctctgagggtcctaaacagtggtaactagaggccctgggcttcctttgtatttaccagagtccagatgaaactcctggcccctgtttttcagaggcattaagcaaaagaaatatgtctttttacattttataaaactcagaaaaatggctttaaacagcttttgctctcctgctataattatttattttcaaacactcctgcaggggaccgctccgttttcttaccctgaactcctttttctcataaatgaaccatcacttcaataaatcattatggaaacagagactaacaccggctctgaaaggttgaaagatttatgtaacacatttatgtttcccattttctcattctggtactcggctgcaaaagctaagctaataaaagctgctattaatatttcttgttgcctagcaaccccagagcgggagtaatagcttcggctagaaaaatagatgaccgataaggaaaaattcaattcttttattatctcagggggaaatggccttttactggaacattatgatgtacgagtgtgaagttgaacacaaaagatttttttgtatgtgtttgtttttctgtttttaatgaacattattttacctccactaactcttttagggcacttttacttttctttcgtaaaccccccatcccatccctcatgcttaatttagcagctacagtagttaagaatctgtcggcgttctttagtttaaaaatggtttttgcaaaggtttacaactcggtcataaaaattcactccctgttaaaactcaggccagtgataagctaacacgcaggctggttttctgtgaacaggatcacgtttgttgacgagataagattcatggttttccctacaagaaaggtcggaaaggaacaaaacatgttcttttccatgtcccagttttctttggaaccagggacactgtctcttttgagaaccgtttgctctgcagtttgggatgcgttcacactgggagaggatggggcacagatattcactgagcacctgctctgcagagccttggtgccgttcccttctcccagcaccctttaaggtaggaaccattagggtgcctatttttcagatgcagaaactgaggcttagagaggccaagggatcaggctgaggtagcatcttttttatttttagtagagacaggatttcaccatgttgcccaagctggtctcgaactcctgagctcatgcaatctgcctgcctcagcctcccaaagtgccaggattacagacgtgagccactatgcctggcctgaagtagcatcttaaaccatggtgtttcccacctgtgttctttagcgcaggggttcccaacctcggcaccactgacattttgggtgggatgattctctgttattgggggtgtcctgtgccttgtaggatgtctagcagcattcctggcctctactcactattcctggcctctagtagcactaccctagtcaaaataaaaacgaaaaatgtctctagaccttgccaaacatcccctgggagcaaaatcacccctggttgagagcctccgcctgctgttcgctctgctgagaaggctgttccaccttgtccacccagtgaactcctattcctgtatgaggacccagttcagaagttatcttctcacagaggctgcctggatgctctgggctggaacgagggtgaggcatgtgagatgcgtgcctcaaccataaaatttaaaggtgtgtccaaaaagtcatcaagataaaaatagtgttttaacgaaatattttgaaaaggcaagattaacacagaaaaccatgatgaacaacatatcagaaatgtaaattaaggtgggatcagtctgaattcatggcaatatgtggttgtgcatttaccaggggccaccagcctgggatggcctgaaggctgggcctgggccttgtgtctttctctggccccagaatctagcaaagggcctggttagcaggtgaccttcaatgtctgtttattaattactgaatgaatgggagaagggaattacttgtccagggtcacatagccagaaaaaggatagagctgggacttgaacctgggcctctgactctaagcccagttcttcctgcacccgcctggctgagtatgagtatggggtgaatctttgttgtccgctgagtagggacctaagctgtggacgattgaaagatgctctggggtgctcaccgtctaggagtggcgggcagggaacagtggccgtgatttcagcttggtgtcaacccggctttccctggggctgttatttcggcttcaccacctctgtgccaggcgagagctgacgtgggcagctcagtgacatgtggagcatccccaagaacatcacgatggccagccccttgcagcactgctcatgcccatggggccagatgcttcaccttggcctttggaggtcaagaaccacaccttatttgaccttgtatcctctcagtgaacttttcctaaaggaatgggtgaattatttataactgtcatgtaacatttatttagcagttactatggaactggcacctacttaaaccctttctatttataatctcacttaatccttgaccctgagaaggaggtactgttattgttgccattttacagatgagaaaacagaggcacagaggggtaaatgacttggctacacagttatcaaaatgatggtgccaggaattgaacccaggcagcccgactccccagcctgggctctccatatctagcccatgtagccttccaaaatgaatgagtgaatgagcaaggcagtgagcgggacaagatggagacccactttatctgcccagctctgagttgagctattcatattcataaataatctcaacatgaagtgtgaggcacttgcagcttggaacaagaaatggaagaagtgctgagctcaggggactgtcccggcaccgaaggcttcctggagggggtagccttgggggccagaggacagtgggaaagcctgagaggaagaaatttcatatgtgcatggacctccctgttcagacctgatcaccaccccttccgctgaaattcataaaacaatttgtgatgttttatggttgctcagctgccctctggtacccaccctttccatcccctgctgggctcctaatcagagcactcgaggctgagtgcaagggccaggtgtttaacttccactccaggcagcatgccaagcctaacagggtatgaactctgagagctgctcctgagtcatgagggagaattaagggaaaatcgcagcgacattcgtcagctgcagcctcgatattactgggtgtaatggctctttcctccgagtgcatattcaggaccatgtttgggaaaatgagcttttaatgtaccgtcggcattgctgagaagccatctttggctccgcagaatgtctggagcacataaaacttgagatttattggagtcattttccccctgctctgcctggataataaaaagtcagtctcatgagctctctttctctcatcttgtggctttgtccatttagaactcggagcctttataaaaggcagcaagacaaatacagctcatctaaatattaaagctccaggagagagtgtcgggggactatggaagactggaggctgggagcgtttccaggacaagcgcgccccatcagagatttaagctcagcagctgtgttgggctggggcccgggctatggtggtggcagctgcttgcccaagcagtagcacttaactgggagtctggggtcctgggtgcctgttctaccccagtgggtgaccttgggtgaattactgtctctctcagagcctcaagtaagatggagctgatgctgtctactccacagagtgtgggaatcaaacgtgccaatgaatatttctgatgctttgcttcatgtgtggcatgtagcaggtgtctgaaaaaggtttgttgactgactgactgactgactgactgactgaaaaatgaatgaatgaatgaatgaatgaaaaataaatgcctctgtaaacacctcaaacatcatttttggagactaagttacatggggaccctatagcatcttctgtcttacacagcagtctgcttcatatcttctaaccctcctgttgactttaagggagatagaattctgctcatttacagatgtgttcccaagacctaaagggaaggtggcttgtccaaagacacacagctaggaagtggtgaagacaggatgggaccctgattcttttgaccccaagtgctttatgtcctcaacacaaaaacatccctcaccctatccttggcccaggcctctgagctgggatggtgggcaaaggtgggacccttgcccctgtctccctatcgagtgtgggtgttggtcaaagctctcagctgagacagggttaggagggcaaaagtgttggtttaatggctctgtctccaaactcctggtagcaaggaaaaagggaaggaatatcaggtgagtagtcagaacctgtcatagggtgtgtgtgttgggcagagctgtgggactgggatgctggagccctgaggaatctctaactaactaactaagcatggttagttcttcctgtcatcccggaaactgataacaagaccgcgagtcaggaagcctgggtttaacttcctgtctctgccaccactaagagattgtgggagacaagtcactttccttccggcctcactttcttcacctgttgaatggacaaaacctaaatcaccccagggagttgtggaaaggatcaagggagagggggcttctaaagcatttcatgaatgagctcctcaagagattcaagtctctggagggtgtggatcacagccggctcaggagagccccgggattaggaggtagggctccaaggtcaggcagcatcagctgcacatgtaaccagctgtgcgacctcagccaagctgtttaacctctctgtgccacagtttcctcccagggttgttgtgaagagtaaatgagacattagagatgctatctggagccgcgctagagggaggtctgcctggtcccacaggcagcactgcagcgtggattaggccacggagttgctggcatttgttccccagtgtgaactgtgaatcagtcatgggtcacaggccagaagtaggtggagctcctgcataacttcctacgtaagacggccccccaagggagggagagcattaggacaaatacctaatgcatgcggggctcaaaacctagatgacaggttgataggtgcagcaaaccaccatggcacatgtatacctatgtaacaaacctgcacgttctgcacatataacccggaacttaaagtaaaattaaaaataaaaataaaaataaaaagatggcccctcttggccaagggcagttctcgagaaaggggcaggtgtgtgcctttggcagccacactcccagcaggggatccagcaagacagactactgctgagctgcttctggaaacgtgatcctaaggccagcagcagcagcattgcctggggacctgttagagatgcagattctcaggcccctccctagacctggtgactgggagactcggctgggcccagcagcccatgcctaaccacgcctccaggggcttctaatgccagcccagaacactaggctgtggtcatcctcagttgagccctgaattctcagttgttttaggacacataggatgcacttgtgtttctgtttgccttgaggatttcatcacactgaggatggttgcagactttttccccccagaggaactcgaggaccgacacctctgcctgtggttcctggttctttcctaccctgtgcacctcccattgggacaggccttgaagcggaccctctggcatgatgacagtcccagcctgtgatcagaaagactctaggttttcctgaatcgcacgacgcctcatcctggggtgcttcatgggcaattgtgcaccaagggcctaagaagaaccaggaacaaaatgcaacagggaaaagaaagggggcctaggacaggggaggtatcagggacgtcttgtgaccagaacgcaaaattcctcccactgcttatgggggagaggggtgtgcatatgccggggaagggatggatcagcaaagcccattctttgagatcataggaggacagagtgtgagcaggtagacagactcagacatttgcagcactggtagcaactggcccgggagaactggaccttcgtcagaagcacagggtaacagcaaattatggggccgtaagccgagattctaagactgaaggatcagcctgagatggtcgctaccccatcccacaggactcctcttctcctttgggagccccagacctgaggcccctgtccctgtgcacacaagacccccaaccactccctttttgtctgccttgtgaacttgacaccttcttaccttctgcttctgtatccctcctctgagaagcagattaactctagccagtacattggctgtgccctgcatgcttccactaggtcgacttttttttgagaaagagtcttgctctgttgcccaggctggagtgcagcggtgcaatcatggctccctgcagcctctaccttcctgattcaagcaatcctcctgcctcagcctcctgagtagctgggatcacagacacacaccaccatgtctggctaatttttgatttttttttttttttaagagatggggtttccctgtgttgcccaggcttgtcttgtactcctggcctcaagtgatcctcccactttggcctcccaaagtgttgggattataggtgtgagccaccacacccagcctaactgactttgatcacactaaaccagaactgtaccttcccataacccactgcaaaatgaattccagatgtggtagggagcaggctcactttgcccttagcacgtggcggaaggcccgtcacccacacatgcgtccacagcacaagtgagcaatggccggccgatgacgctggagacaaaactgtccttcgggaacagccccttaaccgggactctccttgtcttctctgtgcccatggccctgctgagaggggggtcagcacattgccagaattaatgtcactggccttggacttggagagaactggattttgagtttctccagctacatgcgtgttgaggaagttacccaggccctctgaactttagtgtttttttttgtgtgtgtaaaatagatgtattattcattcttaccttgtgggttgctttgaaaatcagatgctgtcatgattataaagtactcagcatgggagccatggcaatgctattatttgtctctaagcactttacgtgtgagctgtctctttttcttccctgccaaccacatagagggctctgtatcctttctggttcccccaggaagtccaccttcccaagcattggtgaactgacagtggatacccacatggtctcacaggggtacctggcacaaacagtttactcatttttgcagttccatgccttattgtggccacagtcactgtgagcctgtgagtgtatccctgccctgtggcatgttccatgcctggttcttctctcggttctgtctgtcacactgtgagcccctcagccctggcatctcccctatacttacctctgtgcccatgaaaccaaagctcctccatgggcaggacctgccttcgttagaaattagcttagtgacccctgagtggggtgtccttgggatccaccctccaccccaagcaggtcctcagtgtgtttctatcaaacaggtacaatttttctcccagagacagattctagttgtacattagttggagtctaccaagaaacaggcaccagacgggattagatatgtaagaggagagagagagggaaagggaggtggggggaggaagagaaggccagaggaggggggaagcttcagaccatgatataggtctgaaaccagagggaaaaaggatgggaaggagggaggaaagggaagaaagaaggaaggaagtgaggtaggagggaaagatagaggaaggaagggacagaagggaaggaaggaagggatcccagcactttgggaggccgaggcgagcagatcacctgaggtcaggagttcaaggccagcctggccaacatggtgaaaccctgcctctactaaaacaacaaaaatttagctggatgtggtggtgaacacctgtaatcccagctacttgggaggctgaggcaggagaattacttgaacttgggaggcagagtttgcaatgagccaagatcgcaccactgcattccagtctgggtgacagagctagactttatctcagaaaaaaaaaaaaaaaaaaaggagggaaagaaggactgactggataggaagatctgggtagcaaggactggacaggaagcatcttggactgcatcagttttaagaaagattggccaggccaatggggagtcctcaaaccaaagctgcccatcagaagagctgcacaccttccccaaatggacctgccttaagcaccaatgtgttcagacactgactgggcgtgaccacaggccagcgtggcctgggaggcgcatgctcagggagccgaggagctgcagctggtgctctcagcatcagtgccacctggcacagaaggtctgagtcccacattttggtggccagcacagtccatcccttttgccacacagctctgcttctcatgcaggacagtgagcagcacctccacgtcccgtgggccctcacttctgcagggaaacttaacaaatgacaacctcattgctgcctctggtcttggggctgccaccagcactcacccccttccctccttcctcagccacatcccctctcccttagcccgtcccctctctgatccggtggtggctttttataagatagctttatcatacttctgtattgaggttccactatctttataagatgactattacactgagttctcctgagtaatctactacactgagatctcatacttctgtattgaggttataccatcttcctaagatgattattacattgagctctatacggttattaccatggagttgtatatagtattaccttatctcttttatggtcttcgtatctataattacaccctgattcataatgctaaagtcatatattggtggtttctccctctcttttctgttcacctttacccagggtttatccatcttattgctttatctacattgttttattcattttattcagaggactaagcatcagagttgtgttccaattctcttacttttctttctcttaatgttttccctctttatgaatcccttctttctttttgtagatgtttacattttttattttgaattctttagttcatttacttttattgtttattgtttaataataaaaagtttatggctgtacattttttcttagtatggctttggctgcatctataaattttgaaatgaagtcttcttacatcttttactttcttcccaaagcatagctttgtggatttgatttttaaaaaatggcacatgttcactgtgaaaaaaaaattaaaccaacaaatacaaagaagtaaaaattgttaaaactgcaccatccacaaataatcattattaacccaaccatttactaagtatcttttcagtcttatctttgtgcattatacacaaagataatatatacaataatatatacaatatacaaagatatacaatatacaaagataatatacacaatatataaaaatatgtacaaaatttacatacatgggacccgaatgtgatgccttttcctgtactttccagtgtgttctattggagcagttctaggacctgccaattttctgcaacagtgtatcatgtgtatacttccacgtgcataattacaggtcttgctcttccttttagtggctagataacattccatcatatgggtgtttcatcatgtacttaaccttctgttgatggacatttaggctatttctgatcttttctattataaactctcttgggatgggttctttgggagtggtgaaaaggattttttaaaaaattttattattattatattttgagggtgggatctcaggagagggagggagagatgttaaggcagacagagaagtttcccttggatgcgtcgagcctctgcctgcccccaggggtgttctggagcataaattgcaccacacagttgatcccatcatagggtaaaggggtagcctttgcacccccatgtccattcgtcgttggccagagattgggggatggagtgacctcctggggctgcagtacctgttggcaagtggtgtcctctgaagaagggggcagctgagagccttcaccaaccgatgttcccagcagctgggggacaggttgctgctccagtgaagggggcccaggaaggggccaagaacttctgcatcagctgcacccccactcatggtgccagagatatcagagttctccccctcatgtcagcactgaattttgtagaactttttaaaaatctgaactaatcctatgtgtgaaaaatgttattttctcccctcccaccacatgtctggatccttgggaggaatgagttacagcttcccccactctcagaaagaacccagatcctcagtggaggagtaatttgatgccatcaggagagcagggaccttggggctggaagattccagctcaagccccagctctatcctgggcaatcttcttcaccctttcagcctcagctttctcatctgtaaaaaatggtaaccatcatagcgcctgcctcagaggagggatgtgaggataaatgaggagccatttgtggagccttccaaactgtttacaggttgagaggccctaaagctcctggcggggtggggtggggacacatagtcctctgacgtggccatggagtcctgggtagggggaactctgatctttaagccagcttggattctaagatggcctgttgccttgaacggctgtacctgattggtcaacatttggccattgcccaaaaggggctggggataatgacttctttccgcgtgattatagcagcacaattcacaattgcaaaatgtggaaccaacccaaatgcccatcgatcgagtggataaagaaactgtgatatatatatatatatatatagacacacacacacacaatggaatactactcagccataaaaaggaatgaattaatggcatttgcagcaacctgggtgtgattggagactattattctaagtgaagtaactcaggaatggaaaaccaaacatcgtatattctcactcataagtgggagctaagctatgaggatgcaaagacataagaatgactcaatggactttggggactcagggagaaagggtgggaagagggggaaaaagaagataaacagcatattttgaactaaaaattactccttgatattaatagtgggcattcctcttaaattatggattaaaaaaaccctaggaatttgttttacctcaaaaataaaataaaccgtaataaacctaaaaagggggtgctggagagcaggaaatgtgtggcttcttctgcctccctgacactgtctcaggccagacctccccacacccccttcatcaattaaattgtggtaaattaggcggtaggaaccaccccagaactccaagtccttctgtgcctcaggtccactgtgtgacctcagggctggttctgaccctctctgggcctccttccttcttctgtggggtgaggccactgagccccatccctgagcacccacaactctcctgggaaaggatctgggaagcttttcctgccgcctcctccccaccttgggcatttcagtctcggcttaaccagccacttcaacacaggcaacacttttctcgagagttcataaaaacatgtaaacacgggtgaggatacaaaatattgagcggcgaggcagtaaaacacggcagtgtttgttgtgttaactgaatattcatgagctgactgtttaaattacagttcacaactgttgcagggcctgatgaataatttaaatgagggtggccaaagagatttcaacactgcattagcaaactgctcaggatcagcttcagagaatttataattagctcagaatagcctataataaattctttggaaagatggttttaattagcacatgtgccaattcagaatggagaatgttcagcgttcaggggagggggtgggtcaccctcccctccttcttatgtttccccgtcatgcggaggtcccaccacctgcctgggatccctgagccatgctgagcccacccggaacccaccaccaggcttcctgccttgagtctgtcccgcctccactgccccatcccagcttaggcctctccgccatagcctgtgcagctgcagaagcctctgacctggtctccctgcttctgtgtctcctgctccagttcatccccatgggggcagccagtgggaacttactggatgcagatctgattccatctctgccccatttggagatccttaattgaggaggcccagagagatgaagtggctggtcgagctcaaataggtcccagacaccagttgacttcagccagtgcctaggtgcttggggatgggtgaggcatcactggcagaaggaagtgcacaggcaaagatgaggaggcaggaatgttctgtgtgtcgggggccagtggggagcaggacaagcagaggcttggagaaagcaggggcccgaccatggcgtgcctcaaatgcttcgaggtggaggatgtaggagggaggtcccacttaggggatcatggaggctgccagtctggggcctagagctcccagcccacctggctcattcctcaacatgtgctgagtgcctgacaggtgccagacctcgggctgggcactggggaaacggctcagagcaaagcaccagccacggttccctctttcataaatggagcacacaaccagagccatgtacacactcagccgaaggtacgactaacagctgtgacaagttcaatggaaaaaataacagggtgtcaggagagagaatcagcagggatcctgatttaggtggggagccagggaaggcctcctgaaggcaagggcatttgaactgagtccaaaagtgagtaggggtgaaggaggccaactggtcccaggtggaaggggctgccccattcccagagggggtgctgtggctgggcaggggggtgagggggtctagtagagcccccagcagcagcctagggtggggctggactggttctgggagaggggcatctgtctatggggagctcattgctggaggagaaaataacctacttttctgctcccaaaccctcgctgcagcgcttagagctgcaaaccttgagcaagacattggagtttctctgcttcattccatcaggatcactcacgcactcattcagccctcacacttttattaagcccctactatgtaccaggcactcttccaagccctgagcagtgaacaaaactgatgacaatccctgattcctggagcttacattccagtgatacagacagacaaagacgcaaaggagtaagatgtgccctccctggcactcagatgggggaggaaaggttccctgccagattctctgatgccccctcccagtcctggtgctgtgggcagggctctcagaccccttttgaaatagaaactgaagatcaaattcaggaatttggaggattcacagcttggacaggtcatttttagttatccacctgctgtgaccaagggcagccagttctgcctcctcagctctctcctgtccatgacatctgccccatgtgcctcttgaccctgcctttagcctcttgccctgagcacaggggaacctgctgggccatcccccactcacacaccactctggacccccagtgactgccagaccaagtcctcatccccttgtgatctgcccctcctggctccccaagcttcgtcccttccttggccacagtgaaccctggagtcctggcagccccctgacactcagggtcgccaccgcgctgatgctgaacagcaagcctcgccctccagctccgcttccatcacagcagttctgtggtttgtcattgtttttgaccagtggttccctctcaattcttcacaaagatacagaaagataagtcacaaagattagtcaaaacaagacggatattgctgtgctgacctgcttggtgataacaagcaccataccctttcaggcactctgtaaccgtgggtaagaggatgtggtgaggccagcccagcctgcaccatgcccctctgccctcaatagtgaaaagagctcaaactttggggtcagacagacctgggtttggatcctgatcctgctctgtgtgcgctgcagacagggagccatgaacctcacctcttggaggctccgtttgctcaactgtaaggtggaaacagcagcagcgacctcacagggttgttaaaagaaccacttgacccccaaaatgagaacatggcctgtgagtggcaaacccatgttccagtcacccgcttctgcagttaggatccccatggggaattgctgtgatgggaacacctgccctccacaatcgcactttctgctcagcatctaaatagaaagttgtcctgtgacacctgcttactgtctcctctctcccctcgtggtcccagcagagcttccaaaagggggtcattgactctggctgtctatatttcctcccctcccatttgccttgacctctgcctccctgtgactataaaactcctctggttaggggcactgatggccttcacgttgccaaacccattgggcacctgctgtctttatcatccttgactttgactgtattagaccaggctcctggtgtcctccacccctcaggccacccttttgcaccctcctttataggactctcccgatgctccacgctcatggctgggtaccacaagggagtccaggccatttccactgctctatcccctctcctaagcaccagaccatgcaatcggcccccacctggaaacccccacttggatgtcatccccaagttcagctgtctacagctggccactctcccctacctggctggatgtgtctcttctcctatgtaagcagcccatgaatttcatcagtaatctggtatgagtcttaatctgccagaaccagtccccaatcctaagtctctccctccatctcttgctttccatctatctgagtctcagatggtggctatatcacctctcagctggaagttgccacctactcttagcagccaagctggcctttctgaaatacaagtcactgctctgcctaaaactcttatgggtttccaatgaccctcaggataaagtccaatgtcttcccctggcattcaaggcccacccagcctggcccctgcctgtgactctaagctcctccttccccaaccctcctcacccctcccactatccttcactcctgccaaatcagggcctttcctgatgcccagtgtgcccttgaccgctgatcttacagcctcacttggcctttggcttccctctcggccctcaccaccactgtgactgtgtattgatttgggtgtagatgagctccacagggcaggggagtcccagtgctcagcacagggcctggcatatagcagatagttaataaatacagatgtgcctgctataaagtgacacatgccttcctgaaaaacctgaaaaatcctaagaacaagagtttatgggaaaaatagagctgggacaaactactcaaggtctatgcaactttgtaaccagagcactaagagaaaaccattacattcctaatgtatatatctgcacaattaaaaagcatttgttaaattcttccttaaaaaccctcagtaacaactggggaggcattttgatggaaggggttttgaggaagggtggggagacattttgatggaagtgggtgtgaggttcactgctgagttatggagacaagggcaaaatgcacaaagatggagaagcaagcagttggcgcctttacaccagagcaggtggccaagtggtatgaaggtgggccaagtggtacacaagggcaggtgggggaaggtgggcgaatgggcattggaagcagcgctgcttcctccactgtttgctgagtcctgctctgttagcgccctctgtgttcagccgctgttccttggtagcataaaatagtactgcgctggaataagcctgtatgactgagcaggactcctctgcaatgccactttccccgttcactggaaggggtgagatacttgtgtcacaggagcacgctgcatttgtcaagtgggtgagcgcattagtagcatgggttgtgctatattggtgcgattagctcattccatctgtttgtcccgctggacttggtggccccttctgcgtggcaaggtctgtgcctgcattctttgtgtctcaggtcctgtggctcattgaccgccaccgtttaggtcctgaggctgtgacagttcacaggccactgtttctgccctcaaagaaccaaccgagaatacaccatgtggcctgtgggagttacccaaaagcacttgctggagaaatgcctaagctgcccattaagagacttaccataggccaggaaaatgaagtgggctctgaaccttggcaagaaggggtggatttgggagaccaggaggaggtggcatgtgcttttgagggcccagcagaagtggagggtgaagggagggggaggttggtggataactcattcaacattcactgaaccccctgctaggtgtcgcggtctagataccagcaggcgctggtctagataccagcaacacatcagtgaacaaaacaaagatctttgcccatgtgcaatttacatcctagcagggggagcgagataataaacaataatctactaaataagtcatgcagtatgttagcaggtgttaagtactttggaagaaagaacagaagcataatgggatggggaatgctggcccggtgtgaggggcaggggagcgggttgcagtattgggtaggatggtcggggaaggccttctgataaaactgtggtttgaaggaagtcttgcagtaggtgagggagggagcagggtgagtatcccctgctgggtgggggaagaacattccatgcagaggcagtagctcacctcccatggttttccagctcagcactactgacattttggactggattgttcttcattgcggggctgccctgtgcattgcaggatgttggccagcttctctggcctctacccaccagatgccaggagcgtccccgcggttgtaacaacaaaaatgtctgcacataatgccagatatctcctggggacaaaaatgcactgagctagaagagagccctgtggtgggaggctgctcgagtgctgaaggaagagcaagtgggggtggatgtgatggagaggggtgatggaggggactggagttggggaggccagagaggtgccaggtggtggtggtggtggttgagttgttataggggcttgtggctcagtaaggactttggcttttacttgagatatagtagggagctggagctggctctgagcagaggagagagggtctgtattgcagaggtggggagcacggggactccccacagccccatcccaacctgaacagaaacctcacacccccagctgagcaatcccagacccaggggcttggtgacccgtatttgcaaacctttcttctaagacaaaaccagcccccaaaggggacaaattgcttttcatttctctgcttctctgccggcggcttcatattcataacacgatgatcagtatcaccaggaatggggctgttgccttaaaggataaattagtctgactcttaactcaataattaaaactgtgatggcacttggcctgcagggataatatgctattattatagtcgtttgtttcaattaaatgcttactgattttacaatagcagctgggcacctgtgcgctacagctattattctgaacaagacatctacatttcaggagaaatttgtcagcgtgcaaaggatctcccaccaagcatgaaagtgtattagcaatacgtactgacgaggcttcggggccagaggcaggcacgggggaggcttcctattggttctcttttcctctcttttgtgctagattttttttttccaaaaaggagatagttttcaattatttgacacttgaagccccaggacatctcagagagcagtgtgcccctgggaagactcgcatgggggagctttagttgtgacttcccacatcattgattctgggctgcagtaaactgaatcatgccccaccagatgcccatgtcctgatccctggggcctgtaactgtgttaccttatatatcaaaaggggctttgcagatgtgatgaaggtaaagatcttgtgatgggcatatggctctggtttatttgtgtgagctcaatgatgtaatttcagaagtacttacaagagggagatgggagggcccaacagacagaaccactgctgatgaaaccacagaagcagagagcaaaaaggtcatgtgatgtggggccacaagccaaggcatgaggatacggttcatccaaaaaaaaaaaaaaaattatggaaatgcttctcccctggagcctccaaagagaacgagccctgccaacaccttcactttagttcagtgagactcattttggacttctgacttccaggaggtgcatgtgctgttcttgctcctgcaacggaaggaatttttattaagtttgtggtaatttattacagtagcaacaggaaactaatacacagagtctctgctgccttctcagaggactgagacgtgtcgactttcactggggaggcagatatgctgcagatcatagggcttcttgtcagttatcagtgcccagacctgttgcctgtggccatccacttagcatctgcaagcatgcttaccctccaacaagtcccagcctctggatacccctttatccttatctgccaccctacccatcactccagccctgccaggctccaggcagcttgcagagctcatcgcactggcccatgcctcagtgcctttgcatgtgccgttcttgctcctggtacaccctctgcaccctccttatcttctgcagacttcaagagtcagttcagtttttttttttcctgtggaaaggcttcctggctgtccaggtattggaggggctccttctctggcaccccacaggaccccaggcacacctgggttgctgcactgtttaaaattgtggggtcatttctgcctcccccaccagaatgtgcactcctgcgatggggtgtttctggctcagggtctcagacataagaatcctcagggaatgtttatggaatgaatgaatgaatggagtaccaggagcagcatggagctctgggaggtcttgagaagtgaaatggccacagaaagagttgtgatgagggcagctcaagacagaggcctgcagaggatgtgagaaagaggctcgaggcagtgactcaaggaagctcagagtcagaggacagaacagtggccaacttctgggtctctgtcaccatccaggcctctctgccaggtctagacttccaggctggactccagacttgtgacctctgcttctccttccaggactggcatgcaggagctttgtcttgacttctcacatcattgatccaagtgtggtgggctggaagagaatacccccaaaagatgtctacatcctaattcccagaccctgtgaacatgttagcttccatagacaccctgttggctcccaaaacttaacacatgtctgcctgtgctcatcaccttcactctgctcaatcctgctcctccttctatgtctccacctcagagaattgcaatagccaccccttatcaccatttcatcccaagagtcttgcttgactcagccactactcatcccacgcattccactcaatcacctgtcaatatcaatcttcctcagtgcctctcggacctacctggtagatttggccactgccatagactgtaccagccccctctctgggacctcttgtctcctctctcaactgcctcatccatgtgcagccagagtggttccatcgggcaattctgaacacgtcctcccctgctgaaatcccttcgatggctccccatgggtctgggagagccttcccctactctggctctcaggccttttgctgtccatccctgctggcctctgaagcctcagtgaagccaccttgggtcctgccaggtccatgtcagctccacggctttgcacaggctgtttcctcttcctggacaccctcaccttcttcaccagctaactcctgagcagctgcaagagtcaggccagactccacttcctctcggtggccgccgccttctgcagactaggtgggaaggtcgctgcacatgtcttactcctgttcccccacgaccaccacacaaggcgtcttgaaggagggactgtgttctggtcagccatgtgttctctaacccagcatctgcactcagcactggacatactcaacaagggttgctgaagggctggagggagacgtggctgatgcgtggggagaggctggttcttgcccaggcattgggaccctgctcaatgccagggagatgcagagagcttgaatgtgctgggtaatggggtaatatgggccagccaggtggctgtcatctgtcaggttccctggaaacagactccgagatggagattgtgcacagcaagttttaggggagcactctcaggaacgtcacccatgagaagtaaaggaagcagcctggggcagagagagaacttgaaccaacgtgcattgctacagaggcttcagccaatccagtgagctctggaatgctaggatgcgccttctgagatgtcccaaattgagtcaacggggctgggcctttgaacccccacatcagtgaatgtagaccaccccttggaagggcttgtaaccatgggggaagcagctccatcagccacaggcaattcctggagagggttgcagctgcgagctgtcagaagcccatatgcccggcagctggagaactgagtcctgtggtcctgagggggccgtcgggccgtgcaggggtcacagctgcactgattttagagagaggctacaacgcaaggttagagcaagagctcagcttgtggccagcacagggcttggccaagtgagagcacactgagtaggtgttcactgaggctgtgctgggcaagtgggtgcagcaatggggtagggctgtggacacaggcctgggagccacacagacattcatgtgaatccagctgtgccgcctacggccaaatgaccttgggcacgtgacttctcattctgagcctcagtttcctcatctgtaaaatgtcgatgataagcacccctttctcgcatgcctgagtaagaagtaactggtcaacaggtcagtgtctggcaaatgctacctgccacataaaggataacatttctaccatcgcttctacttaccacactccactaccagaaggattgccagtctgtggccctgggccaaaggccctctgcccatttttgtaaataaggttttattggaacacagccacagcccttcatttgcattctcatctatggctgctttcctgctcctgcagcagaattgagttgagtagtgattagagaccatctggcccacaaagcctaaaatatttactgtctgaccctttacagagtttgccaacccctggatctgacaaatatagcgaatatttgtgaagtgccctcctgtgccaggctgggtgctgtcatttttagtgtccttggaggctccctcctggcatccctctcctctcagatttcagaaccttctattgtttctcacctcttcttttcttttttgagatggattctcgctctgtcgcccaggctggagtgcaatggtgcgatcgcagctcattgcaacctctacctcccgggttcaagcgattctcctgcctcagcctccgagtagctgggattacaggagcccaccaccatgaccagctaatttttgtatttttagtagcgacagggttttaccatgttggtcaggctggtcttgaactcctgacctcaggtgatccacccaccttggcctcccaaagtgttgggattacaggcatgagccatggcgcccagtcatttctcacctcttcttagcccagttgaggtgcagttcaagctcataccttaagcaagttaatgaggggatgaagaaaggaaaactttcgtcttgaacacactaggtgtctgactctgtacaaagttagctttttgtttgatcctcacagctgccccatgagggcagggtcattgttaccccatgttgaagctgttaagatctgtatggatacagtggaaaacatctcagactcagaagacaggcagaattctggctttcccactttctggctgtgtgatcttaggcaaatcacttaactctctgggtttcagtgtctttattgtcaaatgggggtgataagagtgcttccatcaaagatttgttggtgactcttctagcatggttcctggggtgtagtgagccctcactcactgaaatactagatattattatcattattattattgctatcattttctataaaacaaagacgttgggatctattggaaagtgctactcttttaaattactcagtgtcaggtagttctttatagcagtatgagaatgaactgatacagaaaattggtaccagtaacggggcgatgctacaaagatacctgaaaatgtggaatcaactttggaactgggtaacaggcagaggttggaaccgtttggaggggtcagaagaaggcaggaagatgtgggcaagtttggaagttcctagagacttgttgaatggttttgaccaaaatgccgataatgatatggacaatgaagttcagtggtctcaaatggagatgaggaacctattgaaaactggaataaaggtcactcttgctatgctttaatttctgattgtgctcagaaattaacgagaagtgctgggtgccgtggctcacacctataatcccagcactctggggagctgaggagggtggatcgcttgagcccaggagttcaagaacagcctgggcaacatagagagaccctgtatctacaaaaaatataaaaaattagccgggttccgtggctccacctgtggtcccagctacttgggaggctgaggtgggaggatcgcctgagcctgggaggtggaggctgcagtgagctgtcattgcaccactgcactccagcctgggcaacagagtccaggaattaaggagacgtttctgaaccctctcaaactgaagcagggacttaaataagagcacaattgaacatagccgttgttgccatcagaagattgattctacatcgtatacatctgtcagcacatcagattggaccctatgcatgtatacaactatgacttgtcaataaaaagaaaagaaaaaaatttaattgtgggggaaaaaaattccacctttccaggctgaagaaaataaaaaaatttaattgtggaaaaaaagaaaaaaaaaaattccgccttcctgggctgagtgtgaggctgtgttgaatgacagctcattcaggcttcggaggacgcagggtggctgccagctctgtgaatcggcagaaggcgggaaggaggaaggtgtgatttttcttgttctctcctcactgtgtggggttacactaagcacacggggctgctctccatagagactgcaaatggggaatttgtgaaaaacgcccttgtgttcctgcagccctgcgaagctattaagctctgcgatcctaattacattcacagccgcctcgttcctgctgcctccgtgtctcctccttcctggggcgggtgcagatgtggctcgggagcgtggccatatgtttccaagagggaagcaggaggctggcttcacttggttcccagacatctcatgagtgccggctgcctgcccagccctctgcctggtgctgggaggcaggtgtctctgcacttgagcagatgccgggaggcaacgtgtggagagctctgccagaggcttggaaagagggtgaggccagaggatggagcaggagagggaaggcttctctgaggaggtgacatttcaggtaagccataaaggaggatgacacagagggcaggtgtccagtctagagagaagcccacatgtccccagggagctctgggaaggggctggagaggtcaggaggagagagattgtacagatcctcatggagcattttacatggctaggccattgctaagtgggcccctgggagctgctgagagatggagagcagggaggcgacatttcatgctccagaagggtcactgcaggggccagcatggtgcctggactcaggaggccatgctggaggctgggactagagctgcatagcttgagatagccctgaaaacagaccctgacacaaaggtttgggtgcaagtagtttgtctcaggggtgaacccaggaagcccttggagggaaaaaggcaagtgagattgaaaggaaagaaagtcatgggttgttacctctgtgggcaacaggaacggggtcctgctgtggaccctctgaaagacttgtggatgtgatccgggaaggatgtcaagtcttccaggacgcaagtcagaatcgtcccactgaggggagaggaagtcgaggtttcatctacaaactcctgttcctcactggctgagggtcattcctggggccccagttggtcagcacttccaggctgtttggggcacagaacaccctcaggcagggtgccgagggaagctgtccgcatgcacaataaccctctgtagggacccccgaggtgggccgagggccggggggcagggtctccactgcatctgctgcagctgatcaggacaaaaggccttagctgctaaaagtgttggggcagcggggtgtgggttctgattggagtaggggtctcgtgagctggtagagtgttctagaatgcatggagggatgggcagggtctcaccacttctgtgtccctctcttgtgagctcaactttcttcttctaaaggctgaaattggctttaagcaaaacacgttttgaggtgaaacttgggaattttagaatcatcacggggatgcccctatctgtaggtgtctatggaggagccacagacttacttggaaggaaagtaagatgggaggaaatgtcagaaccttaggaacaccagcgtttagtgggtgggctgaagaagagcaggaaggactggctggagaggtggttggacagtcaagcactgggccctggagaaaggaaagggagctgggaggggaggcagcaggcccaggagttgaggatggagaagtgtcttggggaaggcatcataacttagggaggagggtgatactttggagaagctcaactccacctttagtagctgtgtgattatgggcaagtctcttggcctgagacttggctttttctgctggggatgattatattccgcctcctgtatagttgtgattaaatgagtcataagtggacatggtcagcacagtgtctggcacatattaagtgcttaataaaaatctgtcctcctcttcctctttctcttcctcctgatgaggatggtggtgaggacactgattacaacggtatgggtagtaatgaggacagatgccaggtgagtcgctggtggggggagtggcccaaggacagtgaggagagacaattctttgcacagttggctgcatggagaagaaggaaagttggggcagaagtttttaagagacctggagctaagagagattttaaaagatgggagaggagtgatattgatgagatgcagccgacagacaggggagacaggagctgaactgatggaggtgggggctgtctagaagcagagcctgagatggggttcttgtgaaggttgtttactgagggaggggctgcaggaatcagggattgcaagggaaggggctgagcatggatgtagcctcggctggagactcgcttcaggctgattccacagggagccctggagcgcagcttcactgcacagccagcagggtggcctttagcacccctgtgccagtcaagcagtggtgaggtctgctgcaaggtgggctgttggcgttaagatgtcatagtctcctgggagaagcagttcccatttggccacttttctggagatgggggcaggtgcagatgatcccagcacacaggggaatgggtacagaagcatggtaaagggggcggggtccggcaccgacagtgtccactacagcgggcatcctcaactagcaggcctcaaatgagaggcatatctttcaccgtggggaagttaggacaaagttttttaaatgccctagaaaacctgggatgcttagtggctgtccccatgtttttgctggtttttatctaagaatagccagtcatgtactgtctttatgaagggaactgtctctctgactgtgagaccctgaagtgcggttggggaagtgggcgctctcatccccaaagcttgccattgtgtccatcacaaagcatggactcatgaaaggtccgactatatattgagaatgtatttgtaactatagcaagaatgaagcttctccacagagacttgacatccttcctgaatcgcatccagttctgctgttgtggctttaattttattaaataggtccaacaagtatttgcttttgcagtgtgcaggctcgaatctaggaatcaggatataaagaaaagtcactggacaattgtacaaaatccgtagttctaaagagcacacattctgagaatcttactccaaaaaataggcaaaaacattcataataaacttcaattatacggtgtatccatgtgatgagaagaatttgcaatcaggaaagattgctttcaggtaaaacatgtgtattagtctgttctcatgctgctaataaagacatacccaagactggataatttataaaggaaagagatttaatggactcacagttccacagggctggggaggcctcataatcatggcggaaggcaaaagagaagcaaaggcacgtcttacgtggcggcagacaagagggcttgtgcaggggaactcccgtttataaaaccatcagatctcatgagacgtattcactatcacaagaacagcacaggaaagacccactcccgtaattcgattacctcccattgggtccctcccacaacatgtgggaattacagaagccacaattcaagatgagatttgagtgtgaaaccatatcaatatgtgaccactggatgtaaaagtttgttgaaagcagcgagcaacactggttgtaaccaaataagtgaagatgatcagctccaggttttctcccaaaactccaagggagaagttaaagggctcaaaattatgactgaaaagataaaagatcgtgatgattcaatgtgtttaataggaaacttagcaaaaaggcaataatcaaataattgtagaaaatatcacttatctgaagaaagtggaaaatgttccaaaggacctagcaaatatcagcaaaattaaatctgttacccacattaaaaacatcatagtgcaatgtttttatttcaaagaaactttgagactcaaaaaagccattattattgttgtcattattatttgggggatcggattttattctaagaggatcaacaagccaatgaagaattttaaggaggatagtagcctggcctgacttatttatatagagagatattaattgcttgggatgtgaggagtgtgaaagacataggattcattatggaggtggaaccaataatggcgtgtcctggctagtgcctggggttgtaagggaaagggagaagtcagggtttctgttcaggtttgtggcttgggtgacagcaagaacagcagtgccattttactattttggtaaaactggaggaggaacagttttcaggagagggaagagctccatttgcagcatgtgaagttttatatgcttgcggggcatccgagggaagatgtcactcagggacttggatgtgggagtctggagcccaggttggggatgaggggatgaggctgaccctgtttcagacatttcagggtgcctaatgtggccaattaagttatgtaggtaccagccatttcccctcattccagacttcccagaactcatcacatttaagtttaacactctgcttggaagagcccatattgttgttgctgctgctttggatctgcttttgaagaaataaatattgcaggtacaagttaaggtccctttgtacctctctgttctcagaaagaaataaccactattctgcagtgagtgtttttatgcttttactacattttcatatatccttgaacacctgacagtgatgttttatattttaaacgtgttcataaaggcattatactgtatgtgtccttctgaaactatcttcactggttattgtctttgagttcatctgcattggcagctgtaggtccacgttggtcaggttaaccgtctacagaattccattatgtgaatacaccacagattttcgccatctcccagttagtgaatgtttatattatttccagtttttttggaattaaatgccataatgatcatctttgttgtaatgcataactttctaaaggtaacatcataactctcatacaaatataagatgaaagcatgccaaaaatttatttaagtcgtgattaatgaggaatccagtaagatatgacaacaggttcaaaggtgaatctgaagagtagacacatatataggcaaacaggaatggtgagataaattttctaagaaatggacccagccatcccattactgggtatatacccaaaggattataaatcatgctgctataaagacacatgcacatgtatgtttactgcggcactattcacagtagcaaagacttggaaccaacccaaatgtccatcagtgatagactggattaagaaaatgtggcacatatacaccatggaatactatgcagccataaaaaaggatgagttcacgtcctttgtagggacatggatgaagctggaaaccatcattcttggcaaactatcgcaagaacaaaaaaccaaacaccacgtgttgtcactcataggtgggaattgaacaatgagaacacttggacaaaggaaggggaacatcacacactggggcctgttgtggggggcggttgtggggagggatagcatgaggagatatacctaatgtaaatgatgagttaatgggtgcagcacaccaacaaggcacatgtatacatatgtaacaaacctgcatgttgtgcacatgtaccctagaacttaaagcataaaaaaaaaaaaaagaaatgcaaaactgcttaatggctatagagcaaccaaacataatgtttggaatcatcctttttacagggtgggatcaattatatccctaccggacaaaatttctttgcatttttatggacaagaatgggtttcactctacctcacacctattaggatggcttctattgaaaagagggagagagagaaacgagtggcgtggatgtgtagaaaccgcaaccggaacccttgtgtgttgctggtgggaattgaagtgatatagccactgtggaaaacagtatggtggtttcttaaaaattaaaaaacagaattactatatgatacggcaattggaattctgggtgtctactcgagagaattgaaagcagaggctccacgagatacttgtgcacccacattcctagcagcattattcataatgcccaaccaactgcctaccagcagatgaatggataagcaaaatgtagtctatacatacaagggtgtattgctcagccttaaaaagggaagaaagttctgattcagctgccacgtggatgaaccttgagtaccttaagctaagtgaaataagtcagtcacgaaagaatactgtgtgattccacttgtttgaggtacctggagtagtcatagttctagagacagaaagtagaagagtggtttccagggctgggggaagagaggaatggggagttcttatttactagggatggagtgtcagttttgcaaaatggaaagaattctgcagacggctgctggtgatggctgcataatggcgtgaacatatttaatgccactgaactgtacacttaaaaatggttgatggtaaattttatgtgtattttatcacaatttaaatttttaatgattaaaaaaatcagttgcattaatgtcacctttctagagcttacaaagttgtaaaataaatagcctagacaaagacgtgtactcctatagaagcaggtaaccccagaggtctgctggacaatgccccgcagttcattgaatgacactcatttgtccatcttgaagtcttttgcagttttccacactgtgtgtatgtcttcttgtgcatgtgtgaaagttctttatagtaaacatcttggagtagaattctaggttataggatatctgcatcttcaatatactgagtgttgccaggttgttttctaaagtgttttacatactagtctacactcctaacagcagtgtatgcagaaacataaatggtccagtaaacttatgaaaaggtggtcaccctcactagtgatcagaatggtggaaatcagaatgactttgagagaatttcacacttagcaggtttgcaaaacttcaaaaatccgccattatcaagagttggtaaaaatattaaatcaccaagtcaggaatatctgatggaagaattctaaagcaggccactgggaagaaaaagaaaacaagccctaatacagagttctaaagctgatttgatcttgaggagctaatgccagattcttgcttaaggcttatagaaggtgagagtgcgtaagctatggggtgggaagaggagaatgtttggagaatacattttaaaaccttctataaaacagttcactttaaatctgtctctcagatatttgtatgattaataatcaaatacatatatgtcacaatatattaagaactgggttagaaaccagtatctacctacacactgtttacacttaaaattatgcaggacaaaaataaaacagtgaaaacttagagtgataatgatagcagataaagtaggatgtaagacagaaacattaaggcaaagatgcttattttttatgagcaaggagaagccacagtaaagacataacattctgggacatttacaggataaataacttcacgttagtgtgtatgcagaaaatctgtttaaattttagagagaaactgctggaaacacaataggaatggcaggctttgtggaaaacagtatggtggtttcttaaaaattaaaaaacagaattactatatgatacggcaattggaattctggatgtctactcaagagaattgaaagcagagtctccacgagatacttgtgcacccacgttcctagcagcattattcataatgcccaaccaactgcctaccagcagatgaatggataagcaaaatgtagtctatacatacaagggtgtattgctcagccttaaaaagggaagaaagttctgattcagctaccacatggatgaaccttgagtaccttaagctaagtgaaataagccaattcttttgagattttacacctaaagtaaagtagtcaaaactgtttattgaatagacatatggagaaatttgtacaatatacagtattatttccaatatacatgaacggttttgcaaaaattgatcatactttggtgacacaatagtctgtataccaaacccctgtgacatgcaatttgtctctataacaaaccttcacatatacccctgaacctaaaagtttttaaaaaggaaaaacaaactgatcatatcctaagctataacaaaaatctcagtactttccaaaaagataaaattctgggagtcatggtctctgatcttgataacaaaggatacattaaataaaaacactcttccaaataactttagggtcagagagaaaataaaatcatcaatgtagactattttaaaaatacttatatgatgtagctaaaattctccctgggagaaaaatcatagttacagtgcagagtttctcaacctcagcactattgacattttgggatgcataattctttgtttagtggggacatccctggccactacccagcagatgccagtagcttcccaccctccagttgtcagaaccaaaaatgtcttcagagaaatgccccctgcatggtaaaattgctcatctcaactcctgccctagatgtttctgttactaaaaaagaaaatgtgaaaatagcttaatttgaaaacctatgtaaaaaacaacatatgctacctcaagtcaacattaatagagaagaaagcagaatttaatgaattatcatgaaagttgtcaaatttttttaacatctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaaattaaaaaaaaaaaaaaaaaaaaaaaaaaaaaaaataaaatataagagctggttctttggctagacagttgaaatatataaacttttggccgggtgtggtggctcatgcctgtaatctcagcattttgggaggctgagacgggtggatcacttgaggtcaggagtttgagaccagcttggccaacatggcaaaaacccatctctcctaaaaatacaaaaagtagccgggtgtggtgacatgcacctgtaattccagctactcaggaggctgaggcagaaaaattgcttgaaccctggaggtggaggcagaggttgtggtgagccgagatagcatcactgcactccagtgtgggcaacagagcaagactccgtcacaaaaaaataaataaaataaattttgagaaggaaaattttaaaaagcaacgtgtattcacaatattacaattttgaatgggaactgatgaaaaccacagagtatatttttaaatatattatccagttatatgctagtacatgttagtatctggataaaatgaatttatatatatatatatatatatatatgtataatttaccaaaactgactcgagagaaaatggaaactgaaatagacctattagccatgaaggatattgtgaaaacaaaaagcactgggcctcagatggttttctgtttaagctctttcattctctaaggaaaatgtaatttatatgttatctatactgttccagggcataagggaagagttcaatttctaaagctgatcataacaaaaacatttgacaaaagtaaccctaaaaaataaaaactaagagatttgtaataaaatacatgccagacacattcaaacaaacatacaggcaaggacagcattattcatatcagactccactgaattcaaggcaaaaaaaaaaatgagacaaaaaagatacttaataaagagtttaatccataatgaagatacaattgtctgtcttctttttgtaataaaaaccaatatcagggccaggtgtggtggctcatgcctataaaatcccagcactttggcgggccgaggtgggcagatcacttgaggtcaggagtttgagacaagcctggccaatatggcgaaaccccgtctcgctctactaaaaatacaaaaattagccaggcatgatggtgccacctgttgtcccagctacctgggaggcagaggttgcagtgagccaagatcgcgccactgcactccagcctgcgcgatgcagcacaactctgtctcaaaacaaaaccgacatcaaattcccaaaacaaacactttaagcattaaaaggagatatttttatggaaacagaaaaattgcaggcaatctggacaagcctgtgtaagattaaagagccaaaaaggtaaggaatctaaagaataatcactgatggaatggaaaaatatactgctgtattcatctgcaaacatagcctattctttgtaaggactgtggaatatgtacacaatttaatcatatttgggtctcaaagaaaaccttaacaaaatctcaaacttgtaaatagtacagaccccatactttgataatttttgttactggaaattgtagccaaaagaaaaagaaaattagccacttagaatttccagaactcttctttttgttagcctttttaaatttaagctccagggtatatatgcaggatgtgcaggtttgttacctaggtaaatgtgtgccacggtggtttgctgtacctatcaactcatcacctaggtgctaaacccagtatgcattagcatttttcttgatgctgtccctccccttgccccctcaacgcgccccagtgtgtagttcccctccctgtgtctaagcgttcacattgttcggcttccacttacaagtgaaaacatgaggtgtttggttttctgttcctgcattagtttgctgaggataatggcttccagctccatccatgtccctgcagaggacatgatttcatccctttttatgactgtatagtacttcatgataggtatgtaccacattttctttcagtctatctttgatgggtatctgggctgattccgtgtctttgctattgtgaatagtgctgcagtgaacacacacgtgcatgtatctttatgatagaatgatttatattcctctgggtatatacccagtaatgggattgctgggtcaaatggtattccagaagtcttcttgaacaactcttggatcaaagaagaaagtagattttaaatgttctcatctaagcaatgctaggtgaggtgatgaatatgtcaattatttcacagtgtatacatgcatcaaaacatatcgtacatataaatatatacaatttgtcatttgtcaattaaaaaataaaatacaactcaaaattgagggggaagcagcaattatgaatctttaaaatgcggaggaagggatagctaaagacaaagaattagaaaacagagaagcagaagtgatacacttgagatttgattcttttgaggagaaaagaaacaacccacataaaactgaaaacctgtttgctttcctaatgaagaaaaaatgggagaaaaacagatacttgatgtttgttagaaattagaaagggcaaataaataaccacagatgcagaggaaataaaaatcgtaagagtatgcaaataggtatgcttcactcaacagggtgtggacatatatttaggtccaaagtcctatcctcaatgcgtgtttagtgtgaaaaatgcttatatgtaaaaccaataactttccagaagtaaccagttagaaaatatcatggggaatggagttaataacaaaattgctgacctgtaggaagaaaagtactcaactttatcaagaaatttatttattcaatgtatttaacacatgcttatacaatatagggcttactgtatgccaggtacatttgatctttaaggaaccctagaatgtaggtttgctcatatccacattttacagatgaagaaactgaggcacaaagaggttaggtaacttggccaaagtcacccagctggtagaatggcaggaccaggattcaaaatgtagttagcgtcgtccagcatctgtgtgcgttgctatcatgctgactgctcagttcatgcagagacatattgcattccaggagggaagactcggtctcatcaaatgatccaacataactggactgagctctctggcaggggctgaaatgcaaagcgtctgtccgaggtgaatgtcagtagaatggcacacagccacggagctgccggtttcccacgagtgcacttaatcatacagaggtccaagtagcatgaggctccatcttgagattcacctgtcagggatcggagcaggagccgcacccatcacttctcctctgcattccctcctctaagtccgctagcacagatgtgatggagtggcaggacagatccttcctaactcaaccctcctgtcctcctctcttagatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaaggtatgtgcggtggaggaacagagcctgaagctgccctcctgtcggcagggaaggggtcctgtggggaaatgggcatcacctccctctagtaaagactagaaaagcctgatgtcccaaggtccccgtaggtgccattcccactgagcaggcgttcctggtggcggttgggatgtccgccacagagctcagtggttttctgttaagacccccaggccacgctggaagccaaggaaaaagcacattggcaggtggagcacctggtcaggggggatggcacctatggggctttgtggcatcgggctttggctgctccaagtgctgagcgtccttgacaagctgtgttccctcggggctcccacagccttgtgcgtaaagcagagaaaattccaacaaatgttgaggggatggggtgagaagatcctgtgaaagttggcaaagactgactcctgaaggccagtgggcgatttcagaggtgtggacggcttcagcaaggccatcggggtcacatttatggccatttggcccttttaggagaaaatattctgacaaaactgtgtggtccagaagacagcacctctgggcctagagtattcactgaccttgagggtggggtgcaaaaatgaccgccccactgggaacatgcattcccccaacattcctggagtctagagtggtttgacctcctcaagaacatggtagggatgagagcccgccacctgtccgggctctggcccttctttgcattgactccaaatccacctcccggtgagagaacatcttgtcttaccagggaggaaaacagaggcccagaaatgccaaagacagaagtgtttgcccagggcctcccagcgagctagtggcagaattaagacttatctccctccgtgcctcctgcctctgtcgatccagtgtcctttccacgtggtggcctcccgaggcctagggcagtaaccctggactttgggggaagaggggtttacttctggatcctggcccagcttcatcctaaggatgactcgacctctattatagtccatgcaggaacggtttttatttaacaaacactctctatgggccagacactgctctaaacacataacaagtatacgtccatgtaatcctcataaaagtcctatagggcagggactgttattatctctgtttggcagatggggacactgaggcacagagaggttaagtaatgtatctggtgtcacacagctagtaagtggggggaaccaggattcaaacccaggaggctgcaggtgcagtccagtgtatgtgccctcaaccccctgccctgctgtgcctgttcaggactttatcaatgacaacatgcctcttcatccctgatcttgctagggtcacaccacggtgctaacacaactggggcttggagaagggagtagctgcagagataagcctcaggaacagaaccatgtccttcagacatggatgcctgatcatgcctactggcccatggctttgtcatcaggtcaacatgtcacctccatcttcttggctcctagagccagagtcttcactacagggtccagggcttttgaccaaagtcccctgttcctacatggcttgagtgacccaacagagacccactgaggtctgtggtgggcatcccaacaccaccccatcctggaagccctaagtcaagtgttcacaggatcatggtcctgcagtctgtccagagtgaagccactggttccagggctgacgcagtaacagtcgctttagcctcgtgccctccccacttcacagggtcaagggactaagccacctgctcaaagctgcacagctgaaacatggcggtggagaccagccttttgtaatgcaggatcctttttggggattgtgctcacaagtgggagggcagatatatacacacacacacacacacacacacacacacacatatatatatacacacatatatatacagacatatatatactatatatacacatatatatacatatatactatatatatacatatatactatatatacacacacatatatatactatatatacacacacatatatatacatatacacacacacacacacgtatatacacatatacacacatgcacacacactccaaacttggaaataggcccccaaataactgcacattctttcaatgtcataccaaagccttggctaacaggctcactcaataattatctgattccctaggaaactggacctttgctttgattcattattcactattgattaggggatttcacaactctgtaaaagaagatgttaccttgggcgggggaggggaagtgataagagatgtaagggatttttgtctgattataaggcaaattaactttgcccggtagagatgcaaatttctgtccagtagaaaagattaaaagtcccaaaggtgatagtttcagcgctctattgggcactaaccagtttcacgtgtaatttagtaatctaattccagcattctttccattctttcagtgactatacagtccgtcttctcctcctgcatttctctgaatcaactttacaatcatgctgattctctttaatgagttaaacacccacccagggtgtgtgtgtctgtctgtccattgccccctccatcgcgcgagtggttatctgtgcatgagcagggctggagaagtgcagctcggcccaagtctgtgttgatcgcctttggcaggaggcccttgggcttctttggttttctgactcttctcactcgggcagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggtgagcctccctctctttctgggccatcccctgaggctttgtggtcctggaaccaaggacacactttgaaggtctgaaaccaggcccagctctggaactagagactcttacagaggtctttcctgggctcaggttgcccatctgtaaactgggaagctagctgccttccaattctactaaccaactgcatttactagcaacttaaccactctgaacctctgcttcccgcaacttaaccattctgaacctctgcttcccccttgataaaatgagaacaagcatctccatccatcttgtcccaccaaccctaaaagtctggagtccaggccagagcttcctatcccactgaccatgtgcctgtggcctcctctaaaggcctccagggagaatagagagcagaactagctggtaggcaaatggagttgccagctgtgtgacctcagcctgaccacctaaactctctgagcctcggttttcatgtctattaaaacaggggtgctggctactccttctctgagctcacatctgggctgggctttccccccggtatgtcactgaatccttacaacaccctgtggagtagccattgctttcctgtttggtagagacaccaagaggtaaagtgactcacccagggtcaccagcgtgaatcaaggtagagtcaggatttgaactcacatctgtagaagcaggaggctcaactgggctgttggcatgagagacatgaatcaaataagcagatgagtaaatgtaaaattacaattgtgattgtgccgtgtaccaggagggtacatagttcatgagagtggaaagagcagggacggacattgtcccaggggtcaggtcaccaggtgagacctgaagtgtgagttctctttggaggaggggaagtgttccagacagggaggcctggtaaggaaggaggctggaaaagcacaggggactgaaaggagaccaggatggccagagaggagacaataagagtacccatggcagagacggagctggaaaggagggcaggggccagaccacgctgggctttgcagaccttggaagtagtcaggccctgttctaagaggagagaaaaccagtgaagagttttatgtagaggagagactggaacggcagcataaggcaggtaagagtggatgtggagggtgcacagtgatccaggtgggggaaggtagggtctggagcatcttccagaatggtttagggtaggggacacagagcatgtcctgggagcctccttgcatctggcttccattctgagtaaatggagatgccagtcactggatgggaaatatggggaaagtagcaggcttggggcagagagatgaattactgacttatttgaaacatcatctttaccgtattctaaaattttaggtaattttggaatatgttataatgcagagagtttatttgggagatgatccccacctctggtaggggagtggggaaatgagacagggaaaggagggcagccaggaaagggcacattgtcccaggagaatccaccatgggcaactggagcacaatcccgctgggaactcaggagcctgcttagaacgtgccaggcctcagggtcatcctgtctgaggggcaagggtgctggggtggacaccagcattccttcagagctgctccaggggacattacttctgcagcacccctggcctgctacacatgccaggctcctgccaccagagggaccctcaggcaaaggaatatagccggtggcagctggaagtagagcatgtttgtaggacaggggtaaggactgggggatattggcagggcactgtggcttttgctatagggacgtctgtcattttcacttgtgtgtttcgttggcaaccaattccctttcaaaagacttcaggttgtttttgtttggtggggggatttccttgccgttttatacagtctggggagacagtggtctcaagtcctatgtccccgggcactccctccaccgatgctttctctgacctcattcagcgcagcccagaggcaagcaaaggtggttgagagtcccagcccctgtgtcggtttcatttctgcttacctgtctgacgttttatttctaacccaagaacttggcatatatttatttccatccgataatgggcatttctctccttttacttaatgcgttcttttacttaatgcgttataaatggcttgtttctccccattttcctagcaaattgttgagtataaaaagttaggaatttaatttgtaactgccaagcttactatttattttatcatttctgatcatttttaattcctgagtcttctaggtttaaaaaaagtgtctataattatacacatatttatacatatgtatcttttacaaatgataattttgtctcctttgttatttgttttttaagagacagggtgtcactctgtcacccaggctagaggtcagtggcatgatcatagctcactgcagccttgaactcctgggctcaagcaattttcccagctcagcttcccaagtagctggactacaggcgtgccatgcatcaccatgccccacaaaattttttcttttttttggtattttgtagagacagggtcttgctgtgttgctcaggctgacaaactcttagcctcaaatgatcatcccaccttggcctcccaaagtgctgggattagaggcatgagccactatatccagccatatctccttattttgtctcctcacttctcagatttctaattctgttttcttttcccagttatgttgactaggacttctaaaaaagagatgttcagcaatggcggggatagtggtcttcttactttgcattacctctcatgtttcactattaagcataaggctggatgttagcttgtgtcagtttttgaaatcacatttagaaatgtgacttatattcctattttactattaatacactaataaccaagagaggtagtgagaaaataataggaaataaaaaaaccttgcctatcccccaaaagtttcaagcctaggtgatggataggaaagttctttcaaatcatcaaagagctaataattccaagacttagaaaaataagaaaaccttcacaagtctttatatacaatgtaaccttgacactaaaacataatgaagctaactgcatcatttaattttgaatgtgtaataaacaataccaaaatttaatggcttaaaacaataatcatttattcaacttatgattctgagggtccatgaactgtgctgggctcagcaggatggttctgctgctgctcttggctgggctcacccatttgcatcagtggtcaactacagtaaattaggcatctctgcttctgggagttggatggctgtcagctggagcagtggagccaaactgggccatgtgtctttcatcatccagcagactagctcatgcttattcacatagcaagtcagagttccaagagcagttttagagcagaaaaatggcaggaaggaggcaggactaacttgcagctcccactcggacagacagagcacggagactcacattgtgaacttttgctccaagaactaccacaggaacatactaggaaagccaaaagaatccacagacactttgaaggatgtggattgctgctgcaggctctctgggacagccaaggaattgtgagttggcgtgctttctcagctgggaggcctgtagcctggggcaagttctcagccctgttcactagctgcctggaaataaactcggtgctgttgggggtgcatggtgggagtgagaccagcctgtggctgccagctttccctcacttccctgacaacctgtgtgatgcagcagtcagccataatccctctgggaaccacaacccccacagcatctgcagcaagccccacctaaccctgcccctacctgatggtctttctctacctgccctgttagcctaagacaaaggacataatctctcttgggaactccatggccccgcccaccacctgacactagggcaagcttgtatcctccctatactactgcagctgatgtgctctagaaagtgctacctcctggctagaggccaaccaacacaaaaccagtgcacttaaaaatacaaccaaggaccctcatggagtccacttcactcccctgctacttccactggaccaggtgttgatatccatggaggagagacctgaagacagatcacatcacaggactctttgcagacactccccagtactagcccagagcccggtagctccgctgggtggctagatccagaagagaaataacaatcactgcagcagggctctcaggaaaccacatccctaggggaagggggagaaccccaagggacaggagaatctgaatagcagccttgagtcccagatcttccctctgacatagtttacccaaatgggaaggaaccagaaaaataattctggtaatatgacaaaacgaggttatttaacacccccaaaagataacactagctcaacagcaatggatccaaaccaagacaaaatctctgaattgccagaaaaagaattcagaaggttgattgttaagctaatcaaggaggcaccagagaaaggtgaagtccaacttaaaataaaaagaattatacagcatatgaatggaaaaatctccagtgaaatagcataaataaaaacaatcacaacttctggaaatgaaggacacacttagagaaatgcaaaatacactgggaagtctcagcaactgaattgaacaagtagaagaaagaacttcagagctcaaagacaaggctttcaaattaacccaattcaacagagacaaaaaattttaacaaatgaacaaagcctccaagaagtttgggattatgttaaatgaccaaatctaagaatcactggtgttcctgaggaagaagagaaatctaaaagtttggaaaatatatttgagggaataattgaggaaaacttccctggccttgctagagatctagacatccaaatacaagaagttcaaagaacacctgggaaatttgtcacaaaaagaaggaaaggaaaacctttcagattaacagcagatttcttagcagaaaccctacaagctagaagggattggggtcctatttttagcctccttaaacgattagccaagaattttgtatccagcaaaactaagcttcattacagttctttttttcaaagcaatgctgagagaatttgccactgccaagccagcactgcaagaactactaaaaggagctcaatcttgaaacaaatttttgaaatacacaaaaatggaatctccttaaagcataaatctcacaggacctctaaaataataacacaattttttaaaaaccacaaggtatttgggcaacaaatagcacaacgaatagaatagtacctcacatctcaatactagcactgaatgtaaatggcctaaatgctccacttaaaaatacagaatggcagaatgaataattgaccaactgagtatctgctgtcttcaagagactcacctgacacataaggacacacataacctttaggtaaaggggtggaaaaagatactccatgcaaatggataccaaaagtgagcaggaatagctattcttatatcagaccaaacaaactttaaagcaacggcagttgaaaaagacaaagagggacattatataataaaactagtccaacaggaaaatatcacgatcctaaatttatatgcatctaacattggagctcccaaatttaaaaaaataattactactagacctaagaaatgagaaagatagacagtaaaacaacaatagcgggaaacttcaatactccactgacagcactagacaggtcatcaagacaaagtcaacaaagaaacaatgaacttaaacttaccctgcaacaaatggacttaacagatatttatagaacattctacccaacaactgcagaatatacattctgttcatcagcacatggaacgttctccaagatagaccatacaataggccataaaacaagtctcaacaaatttaagaaaataatagaaattatatcaagtactctctcagaacatagtggaataaaactggaaatcaactccaaaaggaaccctcaaaacaatgcaaatatatggaaatagttaaataacctgctcctgaatgattgttgggtcaacaatgaaatcaagatggatattataaaattatttgaactgaacgataatagtgacataacctatcaaaacctctaggatacagcaaaagtggtgctaagaggaaaggtcatagcattaaatgcctacatcaaaaagtctgaaagagcacaaatagacaatgtaaggtcacgcctcaaggaactaaagagagagaacacaccaaactcaaacgcagcagaagaaaaaaatgaccaagatcagagcagaactaaatgaaattgaaaccaaaaaatacaaaagataaacaaaaagctggttctttgaaaagataaataaaactgatagaccattagtgagattaaccaagaaaagaagagagaagatccaaataagctcaattagaaacaaaacatgagatattacaaccgataccacagaaatacaaaagatcatttaagactactatgaacacctttatgtacataaactagaaaacctagaggagatggataaattcctggaaatatacaaccctcctagattaaaccagaccaataacaagcagtgagattgaaatggtaattaaaaagttaccaacaaaaaaaggccaggaccagatagattcagagctgaattctatcagacttttaaaggacactattccacaaaataaagagggaatccttcctaaattattctatgaagccagtcaatcaccctaatacccaaaccaggaaaggacataacaacaacaaaaaaacgaaaactgcaggccagtattccttctatgcccaaaatcagcatagaagggatatacttcaaggtaataaaagccatctatgataaaccagagccaacattatagtgaatggggaaaaattgaaagcattccccttgagaactggaacaagacaaggatgcccactcttaccacttctattcaacagagtactggaattcctagccagagcaatcagacaagagaaagaaagagcatccaaatctgtaaagaggaagtcaaagtgttgctgtttgctgatgatatgattgtatacctagatgaacatgaatgcaaaaatcctcagtacaatactagctaactgaatccaatgttgtatcagaaagataatccaccatgatcaagtgggtttcataccatggatgcagggatggtttaacatacacgagtcaataaatgtgatataccacataaacagaatttaaaaccacatgatcatctcaatagacacagaaaaagcatttgacaaaattgagcatccctttgattaaaaccctcagcaaaatcggcatagaagggacataccttaaggtaataaaagccatctatgataaatccagagccaacattacactgaatggggaaaagttgaaagcattccccctgagaactagaacaagacaaggatgcccatttattcgatgcagtactggaagtcctggccagagcaatcagacaagagaaagaaataaagggcaccaaatcagtaaagaggaagtcaaactgtcactgtttgctgatgggattatcatatacctagaaaaccctaaagactcatccaaaaagctcctagaactggtaaatgaattcagcaaagtttcaagatacaaaattaatgtacacaaatcaatagatctgctatacaccaacagtgaccaagctgagaatcacatcaagaactcaaccccctttaactgcaaaataaataaataaataaataaataaataaataaataaatgaataaataaaatacttaggaatatacctaaccaaggaggtggaagacctctacaaggaaaactacaaaacactgctgaaagaaatcgtagatgaaacaaatggaaacacatcccatgctcatggatgggtagaatcaatagtgtgaaaatgaccatactgccaaaagcaatctataaattaaatgcaattcccatcaaaacaccaccaacattcttcacagaactagaaaaaacaatcctaaaattcatgtggaatcaaaaaagagccctcatagccaaagcatgactaagcaaaaagaacaaatctggaggcatcacattacccgacttcaaactatatggccatagtcaccaaaacagcatggtactggtataaaaataggcatatagaccatggaaaagattagagaacccagatataaagccaaatccttacaaccaactgatctttaacaaagcaaacaataacatgaagtggggaaaggacaccttattcaacaaatggtgcttggataattggcaagccacatgtagaagagtgaaactggatcctcatctctcaccttatacaaaaatcaactcaaaatggatggaagacttaaatctaagacctgaaaccctaaaaattctagaagataacactggaaaaacccttccacagacattggcttaggcaaagacttcatgaccaagaacccaaaagcaaatgcaacaaaaacaaaggtaaatagatgggacttaattaaactaaaaagctgcacagcaaaagaaccagcagggtaaacagacaacccacagagtgggagaaaatcttcacaatctatactttcgacaaaggactaatatccagaatctacaaaggaactcaaatcagcaagaaaaaaacaatcccatcaaaaattgggctaaggagatgaatagagaattctcaaaagaaaatatacaaatggccaacaaacatattaaaaaatacttaacatcattatgatcagggaaatgcaaatcaaaaccaccttactcctgcaagaatgtccataatcaaaaaatagatgttggcatggatgtggcaaaaagggaacacttttacactgttggtgggaatataaactagtacatccactgtgaaaaacagtgtggaaattccccaaagaactaaaagtagatctactgtttgacccagcaatcccactgcttggtatccacccagaggagaagaaattttacaaaaaagatacttgcacatgtttgtagcagcccaatttgcaattgcaaaaatatggaaccagcccaaatgcccatcaatcaatgagtaaagaaaatgtgctacatatatatacacacatatatatgtacacacacacacatatacatatatatgtacacacacacacacacaaacaccatgaaatactactcagccataaaaaggaaggaaataatggcatttgcagcaacctggatggaattggagacaattattctaagtgaagtaactcaggaatggaaaaccaaacattgtatgttctcataagtgggaactaagctatgaggacacaaaggcataagaatgatacaatggactttggggacttggggaaaaggatggtagtgaaggataaaagactatcatcaggtacagtgtacactgctcaggtggtaggttcaccaacatctcagaaatcaccattaaagaacttattcatatacaaaaaaaatttttaaataagagttccaagagtagcaagagggctcaccaatatgtgatcactttgtcagtctctgcatgcatcacatttgtgcttgtcttattggccaacacaagtcacacaaggctaagctccaagtcatttgcacctcctcgtttctaccaaaagccatggaaacaaggaggtgcgaacaaactgggaccagtcctacaataacatatgaacctaggtctaaaatttttaataaaaaatattagcaaaccgaatccaaactaacatactatgaacaagtaggttcattctaggttgcgaaggtggttcggcattaagaaatctgcactgtgctggctcagaatgggggcttcaaagggcattgtctttctgtgatcagttgtgctgatagaacctggaggcccagagagatgaagcatgttggccaaggccacacagtgacttggctgaggaactgggatatggcctggtctccacaatttctctgcagcgctcccagaaaggggccagtggctggctgactcagcttctgaccccaccaccctcgtccattcgtgatccttgaatccatgccttcccaccccaggaccctgcacggcatctcctctgtaactttctccccagtgttgctcatgtgttgactcttccaggcctacaagaggaagacagaagcagcaaagaaggaatatctgaaggccctggcagcctaccgggctagcctcgtctccaaggtaacacccggaatctccaggcacagccctgatcagagtggggccacttgaggaatggagcaagaactggggcccgtgggaagggccggcaccccaggtcttagaaagaatggctcagacctacatggtcatgtctgcagggcacctacagcatgccaggctcattctgggcactttacatgcatttcattggcttcttccaacaagaacccagcacccagaggggttgagcaacttgcctgaaaagatccagtttgttaaagtggccgcactaggattcaaacccagttttgccagttttatgtggccttcacttctgaccgctgatggggcttgggacacgctaccccaaaatatggcacctcctcaccacaccgtcggcctcctctgtcaacaccagcaacgtaggaagctaagtgtggctgcggatgcgtggcccaagtggaggtgggtgttgttcctggtacagaagagatggcatccaaactggtctataacaggccaagtaaaaggtggttcaaagtcaagggaaaaacatctacaaaggcacagaggttggaaggagcatgattagagctggctcagtgggatggtgcttgtctcactggccaggctgaggagcatggattcccccaagggcaggggagccccccaaagataaaagcagtaggtgactggatggtcagagccaaggggactaaggaccctgtgctatctctggttagtccaagctctctcccaagacagccagccagcagccgtgtcagtgggttgcagagcctcctggcctcacagcccatgttctggctcatccctcttctgttctccagtgactgatatctgtctccttccagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggtaagcagggaagagcagaacagcccttctgtgaccgtgtggggaggggaagcggctttgccctttcaaaccctggccctgccactcaccagtgatataacctcagccttggcacctgacctctctgagcctcagttaccacatctaggaagtgggtctcgcacaccttacctgagatgtgctggctgcagtgaacagttcacgagttgccagactgactcttaggatactccagtccccccttcctgcatcctcagccctagccctggcccttcccaaagccttcgagaccttacccccgctaattgttccacagagattgctacgaggttcacatggcccttagaggtcattgggttcagtaattccattttacagatcgagaaactgaggcccagaaagggaaaggccctgaaagccaagtccttcagcccctgattcagccaagacaagggttgaacattttgaaaggtgctctactgggagcaaggcagcagccctggaggcagcatctctttggtgtggacacccttggacacatgggctctcaccccgggaggcctgggacagtctgccccctcatctctccttggctcatggcctcctccttcccactctgtaggacttcccgcacatctctgagttccccagcagctcgggatcctgctcacctggcccatccaaccccaccagcagcggggactgggacagcagctaccccagtggggagtgtggcatcagcacctgcaggttagtcctcgcccgtccctgcctttgtcctgccagccagggagagtgggaacaggatggccagggatgggagaatggccaagggcaacgtggacaggggaggaccctgcagtcactgtcagccctgctgaggggatcgatatctcagatgacaccgcagagccaggccccggaaggactctgctggcctgatgctgaggcctgcttgggaaactgactagtcttcagtcttgctgcttcttccttgctcctgtttttttcacaagtgcttccacgtgacattcacagatgagtcctgcatcttaggccagttccctagaagcagagcctgaggcagcagggattgggtgcctttggggatgcactggggaaagcttgcaggagaagggggtgagggaggcaggacagggtgggggaaggagctgaggggggatgtggcctcagctgaagacttgcttctgcctcatcccatgggagccctggagcatgaacggtgctagagtggctcccacctggaggtcagggaactggctttttgaacccttcatcagtcagcccttggctgtgggctgccccggggtgagtgtagcccactgggcagggcagctcccaagactagaacagctaagaatgcaggacaggggacctcggtgggacacggtgggagaagggacccactgtctatcccaaggaattacagacaccttagagaccccttctccctgcaccccagtgtcctccctagtcctcctgtgggcctcctgtctcaggcctctgttcctatcctgcactccacctttcaaacccatgctaacacctccctctagaaagtcttcctggatccacgccaccccaactctggggaagagtgacctttcaacaaccgcagccagcaggagagggagagtgcagtgaggagggacacttgctccttaacccgccagccaggttcccattcccttggcaaaaatgagtcccgcagccacacctgggggacgtagtgccaagcagctgtcccagcgatagcgccacaacctggaaggcacagcgcacttgtcgggtggccaccttgctgctgagaaacgctgcccccagccctagcctcggcctcccagcacacggctggttcctctgctgacccaccagcgcccttggacactgaacaagtgaccagcgcgcatgccccatttctgacatgcctgaagtgagattctacatgggtgggtggactcagctcagcaagaatcccttccctgcaccccaagcaggtgcagaccctcctaccccagccctttcctgtccctaagtttccttctcaaaagtcagaatacttagggtatgtaggggagtgtcacacaatgtccaagcctcctgaggcttgcccatcacatccagcatggaggtcagaccccagcagggccgtattttaaaaacataaaaagcacctgtcctcccttaattcagtttgagatttacaaattcctgtgattaaaaacccatgtgagagcaatggtgacatcggcgtgcgcctcgatgaaagacagacacgctactgccctttcacccagagctgaggaccgggtggtcccctgctgggtttccgggaggggtttggttctgcttggtgtagaggtgggtgggggtgggacttgcagatgcaagtccctcattcagccacagaggggcagctgaatccaggggtgggggtggggcgtacagtgcaggggtcctggtgctcccctggcccggagaggtacccaacagctttgacagcccctcctctctctcacagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaacaagtctgtgtctccttgcccttggtgagccagggttgaaccccctaaagtggcatagagcccctcgggccagacggacacgggtcaaagtcttgcctgacctttaccagcccatgtgggtttgtgtgtgggtgatgggaccactctgacctcagtcttgccctctaagggggtaacagtggtcagacccgtagggctcttgcgacgatgagaaggggtgtgggcaagaacgccgccacacaggaacttgcatcagctggtgacagtggcgagcccttcctctggaggatggggccacccaggcttgtggaggtgagcagtgggaatccagggaggaggccaaggggtttttcaaacctgagtgtaggaagcatcccagacagggaattctttaaaccagatttcccagcagatgttagatggtgatactaacaacgacagcaaacaacaacaaaaggcaaataatagttgactgttttaactacatctggaaaaataccaattgcctggtgggaggctgcaactcttgcaccctgtgatgcagccattttgaggtggggacaggtgcccccgctcccagccaggctcgggaccgagacagaggagcccccacactcaggacagctctcccagcctctcactctccaatcacggtaaaccccctccttccagatgacagcccaggagtggggtgcagtttccccactggagggcattttgtaatccactttagaaaaataaaataaccccaaaccagccacctgccgtcccgtcagcagcagcaccgcaatgtgcagcataaatatttcatgtggttacaatttccttttctatgtggggcttgtcagtaacacgacggcttagacagtttaatattcaactcttgcttccatgtttgtgaaaacagcatcactgggatccacgcagacagcccacaatgacaagagtacaaggccctccttgtacagtggtgctgaggcggaggcctgctgccacccctcacagctgcaccaggagctcaggagtcctttccaagcatccacacgccaagaccaccccctctaggctgcacgggacactcagaggccccaagcagaacctaagcgccctgcctgcaggtatcagggactgtcgcacgggtgtgttctggggcccagagagtgagaatagagcctaaaggccaatttcagggccatggagtggacagcgactgtcttagtccatcccagctgccataacagagtgccatgggccaggtggctcacagcaacacaaacttactgctcagttgtggaggctgggaggtctaagatcaaggcgctggcagcttcagtgtcaggtgagggttcacttgctggttcgtaaacgtccatcctctcgctgtgtccgacagggcaggaggggagggtgctctccagaattcaacagcactcaccccaatcctgagggctccgctcagtcaccttccaaaggccccgcctccaaatactggcccgttgagggttaggattccaataatcaaattccgggaggacacaaccattcagtctgtagtgccgactgcagtagttggcactggtgtccccctctcgcctgtcctcttctgttgccagagcccatccccaggtcctgagtgccatcccagtcattgccccccagagctgccacagctaatgaccaaataatggagacgccaactctctggtcccattcacaacccgagtccatgggagcagcctgaagctgcctccagcggcaacaccatccttgctaagctccctccccccaccccgccctgctctgaggatgtgactccctcctgggagcacccactcagtaaatcgcttgaaccagaatccccatctcaggcccgtatgtttctaaggcaacagcctaccatactgactatgcccatggcccaagtggggccacatcggtattgctccaaatgtctctggctctggtcttacctgcaactacaagaatttcagccccgaaaccaccacccaagccccactccagggccttcctccttcttgggaggcagtgtctgctgcatgttttctattccatcctgcaatgatggtggccacgacccacagcgcctccaagaacccagggtcacaccggctgtgaaagcactggggtctctgccatgggctctctcactccccatccctgtgctcccaaagctgccagccctgggtgccccagccttgtcgtgggccaggttctccctgcagcatcctccacctgccggggccagtctacggtcggggcccctcacaccttgaggcttcaagttattgccagaccctagagcagtgtccccaacagtgtgaacacctttaactcctacctgcagcctgcccccactgcccacagagctggcccagggagcaaccccactcacccttcccagggccaagcgccttcctcaggtttctccatctcacacctcccccaacaaactcatctcggtccaaacaggaggcaggacctgggccgaggctgagaccacgccccctcccccaaccccagaaggcagtcatggctggtcccaaaattgcccagtagtcattcctccttggagggatacacagaaatttttacactggattggaatgtgggcaacatggcacagattaattttttgattaattttcagagtccgcgatgctaaaattcgatacgttcattcagcaagaatacaaacaacagagcagctcttctctgccacacagcacatacgtatacatacatcagttagcgtggaattatctgttcttgaaagtttgaagtaactcccatgcgaaaaagatctgatgtgctgttatagattcaggagtttaaaaaaaattgttcaacccatcagttattaaccagctctgcttcccaaattacccaaaacgaataacctcaagcccaccaaacgctgaagggtagtcagtcagagtgagaggcagtgtcggggtggtggttaggagggagggctgggtcacagcctgcctgggagaatattcgcttggctgcctacaagttgtatgagctcaggcaagtttcttaacttctgtttcttcatgtctaacttggagataatagtctcctcttcaaagggctgttctagtaacaatgagttaatataggtaagtccttaaaatagtattatttctcattattatataataatacttaatctctgcaccaggtcaagtttcttgcatcgtgtactattcaggatgtgctaggctacgctgcagaaacaactcccatctcagcagcttaacccaacagagttgatccctccaagcctcctccaagccaccaagaacatttggggatccaaggttcttctctgtggtggctctgccacccccttcaccctcggagccctccctgagtcctctatagccagccagtggtgagtgagccggggatcctgcagaagcaggaaacgaagtggtgcctgtcactgcttcccgtttcctgatggccacagctagtcagcagggatgggaaatggaatcatcccagagaaggggtccccaacccctgggccagtctgtggcctgtcaggaaccgggccacacagcaggaggtgagcggtgggcgagcaagcattaccgcctgagccccacctcctgtcagatcaacagcagtattggattctcacaggagcgtgaaccctattgtgaactgcgcatgcgagttacatgctccttgtaagtaggttacacgctccttataagactctaactaatgcctgatgacctgaggtgcaacagtttcatcccaaaaccatctccccgccgcctgccagccatgggaaagttgtcttccatgaaactggtcactggtgccaaaaaagttggggaccactgtcctagaggaaacgtgccctgggggaaaaatgcaagttcatggaactcacagtgatgctttcgccgaatatcacaacacattttcaggggaggaacatgttgcccagagaggccaaggtacttgctggaggtcacataatttgcatgaagccaagaattaaaatgacctcagaccccacatctctccttttccaaatttcctctacttgcacgtaggaagcaaaactccaggagggaagagagctcaggcactaaagccctgcgggtttgacttgcaaaaagcacccagatcatcactttacacacaaccccagcaactttatcttccagcctttagcatatgaaggaagtcagcaaaaaactgtctgctagaggcgggcacaccaaaagccatgagaagcaatgctgggcaagggaaggagatataagaactcaaacttagcggtctggggacatttggtgcaggatcaaacagtcctgtgcacaccggctgtccctgcaggcatcatctaacatgcttgtaattttttcttaggtttcaacatgtatagggggacatgcatgagttacgagacacatttatttctgcaaaatggccgtatcctggcaaagtggaccagatgacctgtcattgtcctttgaatgaaggacaaagatgatgacattggaagactttccacttggagatctggtttcctcatatgcaaaaccttatggtaatagctatggctcagcctactgattaaatgagacagtatgtgtgaattgcctgggacaatttgatataataaatgttgtttgcttatctttctctaggtcttgctttccttatctgaaaaatgggaatactattaccattcccagaggacacttgttgggattgaaaatgatggcatatttgtagaggtctgactcataacgactcacattctcatgttttattatgtgtgttttttaagaacctgggcctgagagtgaagagagcagtgtcacccttaatctctctggtccccgtttcactctgcctgcagggcgcaagctttgcttctctcctccccaatcttgctactgctaacagaaggtgcagccacccgccacccacctgcccatctctctgccagcctggccttgcctgtgtttgaccttctgccttagagctctgcttccaagtggaggaaggctgccttccagaggtttctattaagtacaaaaacaggacagttggcattcattcagcaagcatttaatggactcctattaagtgccagctgctgtggcaaagtgacaagtgacacagaccaggcaggtctccagccttctggacttcaggatagcaggagaaataagccctaaacaaggacacgcgcaggcgcagagaagacttccgattgtgaggctgctgagaagggtcaaaaatcgctgctatgagcaagaataaaaggaggcctgtcttagatggggagaaggtggggaagaaaggccttttgaggaagtaccctggaggcccgacccagcctgcagtcattttcttgcaggggtcagaggtgtggacgcacacggggtgctgaccagggaggagctgctgtccatccttctcatgagctccagggatgagtgtgaggggccaggggcagggaggtgatgtgtggccccactgcgaatcaacccctgccacgcttacaccctctctttctcctccatggggatccctggtcaccctcctgggcaacaggaaagattccagtcaacattttcttacacaaatatgctaatgaataaacaggaagtgtgagatggtgacaagataggatagggtgacatgacgggggacagcggacaggtagtgtgtggcatctcagagagggaacagggacaggtagcgtgcggcacctcagagagggaatggagctggctgttgagcggagacctgaaggaagcaaagaacaggtaaggacagtatcagaacggagttcctggcagaagaacgggcacacagacgtctggggtgggaagacgctggcttgctctgaaataacaaggaaaccagtgttgcctgcggaaatggccaaaggggaaaatggcatgattttgagaagccggcaggagcctggccaggccgcaagaggagtttagactgtgttgtaagaacaacgggaagtcatctaagtttaggagaggcatggcccaaatggcagttttacaggacccctctggcggttgagagggaaggggatggcaggggtggaggagtggacgtgggaagatttgtcaggaggctgcacagtcatccaggggagaggaggtggcgacgttagacaagggtggtgacagtgaaggacaggaatcccaattgccacgatgcagaatgccactggaaactggatatgtactcacgggcgccatgagcgagagcgctggctgaggagccgcagtcctcaagtcagagcctcagccctggggcctacgccactatgcatttgccacgtgactgttgtgccccctgtacccaagaccgaggctgactttgaggcataggaagggaatcagaggacagaaatgagctttctgaagtgcaagtgcaaagcagtttaaagaaaccactttgaagaagttccaatcaacagaggagccagctgtgatttcactgttgccttatgccgtggactgtactgtgtctccccaaaatttgtatgttgaagcactgaccttcaaggcgatggtatctggagatggggcctttggtaggtgacaggttgagaagaggtcacgagggtagagtcctcatgatgggatcagtgtcccaagaggagacaccagacaccccccccccccccgccacctaccaggtgaggacacagagagaaggcagccatcgtcaagccaggaagggctctcaccagaaaccagccatgcgggtgccttgatcatggactttccagcctccagaactgcgagaaaacaaatttctgttgcttgagccacccagtctgtaatgttttgttagggcagcctgagctaagatgccctgagcattagaaagggccctagggggacaagaaaaggggacttggacctggcagtgtaaaaattgcgctggtggtgccctgcacaggcctttcacacagttttaaaatagcaagtaacatctacgtgggtgtaagggtgctaattttcaacgtccttgacttcaactttaaaactttaataatataattgcggccaggtgcagtggctcatgcctgtaatcccagcactttgggaggccaaggcgggccgatcacctgaggtcgggagttcaagaccagcctgaccaacatgaagaaaccctgtctctactaaaaatacaaaattagccggaatggtggtgcatgcctgtaatcccagctactcgggaggttgaggcaggagagtcgcttgaacccaggaggcggaggttgcagtgagccaagatctcactgttgcactccagcctgggcaagaagagtgtaactccatttcaaaaaaaaaaaaaaaagaaaaaaaaaaccactttaataatataatcaatccttggtatctacaggggattggttccaggaccttctacagataccaaaatccacagatgctcaagtctcctatacaaaatggcatagaatttgcaaataacctatgcatatcttcctgtgtacttgaaatcatctctagattactgataacatctaatccaatataactgctatgtaaatagttgttatactgttttggctttatttgtattaatttttactgttgtacttttaaaaaatatatgtttgatctgtggtaggttgaatccatcatgcagaacccacggatatggaagactgaccacatatccctgccttaaaaagtcaaaccaggccgggcatggtggctcatgcctgtaatcccaacactttgggaggccaaggtgggcagatcacgaggtcaggagatcgagaccatcctggctaatgcggtgaaatcccgtctctactaaaaaaaaaaaaatacaaaaaattaacctggtgtggtggcaggtacctgtatagtctcagctactcgggaggctgaggcagaagaatagcgtgaacccgggaggtggagcttgcagtgagccgagattgcaccactgcattccagcctgggggacagagcaaaactccgtctcaaacaaaaacaaaaaacaaaagtcaaaccagaccatgaagcttataatgatgtcagggtgtcctctgctcttccctccttcaatctctgattctcaccacctagggataaatattctcaactctttttgttatttaacaactgaatatgcacacactgctatttcttgatttatagattttttttcttttttctgagatggagtctcactctgtcacccaggctggagtgcaatggtgcaatcttggctcactgcaacctccgcctcccgggttcaagcaattctcctgcctcagcctcccaagtagctgggactacaggcatgcgccaccacggctggctaatttttagtatttttagtagagacgggtttcacagctttagccaggatggtctcaatctcctgaccttgtgatccgcccacctcggcctcccaaagtgctaggactacaggcgtgagcctagccgatttttaaatgccttttagtcacttcttttcatggaaaaagaggatttagtgctcctcctccatcttgcttccccctgtgtcctcccagtgaactacataatcatggtggttaatcaatattccaggcttacattattcctattctgtaactcatgtttgctgatgggtcaagctacatatttttttccttgaataatttttcatttttgtttttcgtgtgcttaattttcctccctgtcactcattttcccccaaagctcagagctgtaaaccccttctgattatggccagacactttgtgctccaatttgatctctttctcaggcagattccagccatcatcagatgcttccttttattacttagcaaatccccttgcttttctctatcatgggtcctctctttgcaggattccatccattcctccttcctatcttgcttcttcattgtggtggaacacatcttccaggccctttctaagaaaggatggatgagaaataaaggtgcagttctgcaaatgttttcatcttaccctcacacttgattggtggtttggctgggtaaagacatctaggctgaaaataactttctctctgaattttgaaggcacggcttcattgacttctcatttccagccttgctgctgttgagcgttgaatattattctgcctcccatttctttgtatactgcttactttttgcccccttctctggtaacttttagattttctcttcatccaccatgtcttgaaatctcacagggatttaggtgggtcttccctggctttgcgggtggtaggtggacccttccaatctgaagagagccagactgcatctccccttccagcttcctcttactcctagaccatctttttgaatttagaaaccaagaatttggcttctttatgctctcatctatgaagaagtggttttcatcactaatagtaagagtgtaacaaacgaagcacattcattaattcctccacacacgtgtcttccacaggggagtggggagtaggagggtggtctccaagctccttcctcctcccctgtcaggctggctttttatttttatttttttttttttgagacagggtcttactctgttacccaggctggagtgcagtgacgccatctcagctcactgcagctgcaacctcctgggctccagcgatctccacacctaagcctcccgagtagcggagactacagacacgtatcaccacacctggctaatttttgtagagacagggtctcactatgttggccaggctggtcttgaactcctgagctcaagcgatcctcccgtctcggcctcccaaagtgctgggatcacatgcatgagctacagtgccctgcgaggccggctgttgaccacacttacatcctcaactccgcccacctttgatggacagcatattagtcagcctgggctgccataacaacagaaatggtttaaacaacagaaattaattttctcactgttctggagactgggagtcaaaggtcaaggtgctagcaggctttgtttcttctgaggcctctctagatgaccaccttctgtgtcctcacatggccatccctctgcgcctgtccacctctggggtctctctgcatgtctgagtctcgtcttctttgagaacacctggtaggttgaattagggcccatcctaatggcctcatttttaacgtaatcacctctttaaaggccccgtctccaaatacagtcatattctgaggcaccgggggttcgaacttcaacatgtgagtttgggggaacacagttcagtccctgtagatggggtgctcaataatgattagaaaccccacggtgctggttaaatctaaccactggttcatgggccaggtgaaaggaaacagacgcaaatcaggaaggattctgtgtgagtgcacagtagccaggtcactcttctgggagggtattgcaaagtcgaaacgcggcatgctccacctccagctcaccaccgtccagcccaggaaatccacaggtctttgcaggtgccatgcacgctatgctgacacagcacaagggacacttactgataggtcctgggaggacactgaaggacaggactgcctcccgcatctccacagtgactcttggccacaccatttgttacatttcctgggtgccttcctaaacctccaagctgccctggaatcccttgactcccatctacaatatattattagtataaagggagtcgacgaactcacaaccacaagctgcaaattccagtgacgtcagggtcaggcagataacataagcaaaggaaggagacagagggacggacatatgagagagagtgatgaggactggggctaagtggagagggactgccctgccaaaaagcatttaaattcaatgcgtgttggaacaccatcccagccaaaaaacaaaacaaaacaaaaaaaaaccaaccaaacacaaaccaaccaacaaaaccaagtttgctgaccaaatgcagcctccaagcatctagttggtgatctccactgaggatatatggttaagaggacaggctttgaagacacagacctgattttgaatttcactgtttctgtgaaacagtctggtccaaatgttagagatgtgtgagaaatatatgaaataaagcatgtagtgcttagtgcagtcctgacacatagcaagtgctaagttaatagtagctattaatattactgtggtaaataagaaagtagtgacgtgattctaagccttcacttctcaggaacagtgcggagagtactcacgtgtggagtggtggtgcctcctggtggtcataattaggaactgcagagcagtgtagcaggcctaacagaatgattaggagccaagagggctaatttacggtcagacaatgggtttgactccagttctgccatctgcgagtaggtgacacaggtcattcacctccatgcttagcctccatattcaactgccctacacctacaaccccacggagtggctctgacaacttaacaagacaatatgatatcacttttaagggctttactgcatactaagtgctacgatcctaggatgatcctggcatgatgtcagaactcagaacaccgcagcaccacactgccaacatccttctctcttgtgagaaggtgaaacaggtgggtccccagttgttacttattttttcttttattgggtggcaatgagaaggggttactctggaccggagcccctgaccagaaaaatagatctgctgtatcacctgaaattcactggagcaaaatattcctttgagttatgcattgctctatccagacttctcttttaaaccggaagttcccccagaagggtgactgtattagttccaaatacccacatgagcatgagtttatcagctgctcccctccctgacaggaggaggggactgggggacactttgtgctgtcattacctccgtttgggacccctgccccagtcacagccttctgcccacttgccattgctggcctacagagctggcttcctgcctgcctgtgatgggagaccctgccttcaagctggctgagttgtccccaggaggtagagaaccagaggccaggcctgacctcagactgcagggtcccctctcccacggccctctggggaagctccccgcacccaggcctcctcagccctgcccctcctccccaggtcctgagctcttcttccagcaaacagcggcagcatctgcctggaaacacaggaaaggtgcctccacttgtatcctttcctgccgccagatggagaaataaaaacaggaataacagatcccactgccagagcacgtgtgctggggcctctgctgggcactgcagacccattggctcatttcatcatctcgccaaccccatgtgatagatgcaatgattgttcacatttcacagatgagaaaactgaggctcagaagggtgagtgagttgccgaaggtcacagagcttgacagcgggggagcctgggtgggaaccaggcagaccaatgcctgacccttcaccatggtgcaatgtttacccaatgggaagccatcccttccacctccaaatccaagaggctgctgctgaccaagatccagcccattaccctactgtcagattgatcacatgagcatgaattatcaaactgacactctgacccaccctgacaaatgtcactggccaaatgtgtgactggtcataactgacagatggacagacatttggcttgggaaagctaggacctggctaatgtttgcttttaaaagatcttaattttttttttcattttaaattgaggtataatttacagcctctaaaatgcccacattttagattgatgtacagttgatgtggttttgttttcttgtttttgagatggagggttgcgtcttgctctgttgcccaggctggaacgtagtggcgtgatgttggctcactgcaacctccacctcctggggtcaagggattctcctgcctcagcctcccgagtagcagggattacaggcatgcaccaccacacctggctaatttttgtatttttagtagacatggggtttcaccatgttggttaggctggtcttcaactcctgacctcaggcgattggcccacctcagcctctcaagtgctgggattacaggtgtgcgccaccccgcctggccagattgatgagtttgatacacgtgtatgtcccagtcaagctacaggacattcctgtcaccctagaaatctctcacacccctttccagccaacccctgcccccactgctctaggcagccactgctctgatttctgtcactacagctaggttttgcctcttctagaatttcatacaaatggaagtactgggtatgtacatatttatgtgtctgcttccttcacttaatggcttttaagttcatccatgttgttccctgcatgtctttaatttcttcctttttgtccctgaacaggattccattttaagcgatcgggcacagtttgtttttctgttatcctgttgagagtcatgtgtgttgtttctaggttttgacaattatgcctaaagctgctatgaacattcttgtacaagtctttttgcacatatgttttcatttattttgggtaaatacgtgggagtttaaatgcttgatcacagggtaggtatatgtttaacttcaaaataaaacctgtcaaactgtttccccaagtgggtgtatgatctggtcaattaattttaactactcatctggtgagccagaactacctaccaactgacttcctttccagacaaataccatgtgactcatgagctgggcttccagggactagaattgttcctggggacaggctgggtgctgaccagaagcaaaggatgacatttgagaagttacctggctggctgcccgccttctggggcctgtgctgcgcactgcagacccacggtctcccttctgccccagctcctcttgcaggcttctgaggcaaaagaacttctgccaggccaggcatcccaactccctctaaagaaaccctcagcaagatgctcattcggtccctcacatcagtgccaggtgaagagaacgtgaccggggctatcctgaggctgcgggtggccagggacgtaggagggagaaggcaggagctctctaggccagactagagttccatgctcaggcgtgaggctgtacagccctatggtacacctcagatctgggagagggaattatctcacctgtgagagtgtggacaatactgtcaatagcagctcagccctggcctcatgtcagttatcaattgctgtgtaatgaaggatccccaagcttacgggtcaaaatgattattcattctatctcacaaacctgtgggttgactagatggctctcctgctccacgtggttggctagggcgacaggacactggagctggagcatcaaagacggcttctctccatatccagagctcaactgagatgactgaaacatctggggttgactgggcgtctctcttctttctccatccatgtggcctgtccatggagctagcttgggctccctcatcacatggtggtcttaggggcatcaggcttttttttttttttttttttgagatagggtctcaccttgtcacccaggctagcatgcagtggcatgatcacgactcactgcagcctcgacctccctgggttcaggtgatcctcccacctcaacctcctgagtagctgggactacaggcacacgccaccatgtctggctaatttttctatttttttttttttttgtaaaggatgggtctcactatgttgtccaggctggtcttgaactcctgggttcaagtgattcacccacctcagcctcacaaagtgctgggattacaccatgaccagctgaattggacttcttaacatggtgtggcaagctgaacagtctacccccaaaattcatatctgcccagaacctcaaaatacgacctaatgtatggttgtatatgacctcatcttaactagttatatctgcagagatgagaacaaagtcttcacagatgttaactagttaagatgaggtcatactggattaggttaagccctaaatccaacatcagatgtccttctaaggaggttggaagacaaacagatacacacagggacgaaggccatgtgaagatagaggaggagactagaattatgccaacaccagccatgaaatgccaaggactgccaggagtcaagagacaggcatggaatagattctcccctcagagcctccagaaggacccagccctgccaacaccttgattttggccttctagcctccagaactgagacagaatacatttctgttgccttaagctgcccagtttgtggtaccttgttatggcagtgctgggaaactcacttgcatggtggctggggcctgaagatgcagcagaagctaacggcgtcttaaaggctgatcccagaactgacggagcatcaccccgccatgcttcatccggcaaggcagggcctctcagcgtaggccccattgacactggaatggtctcactctgtttgcggagggcagaggaattggaggaggttgctctgtgttccaggatgtttagtggaatctctggcttccactcattgtcagtagcacccccaccaggcccaacaactaaaagtgtccccagagattgcccaatgtcccctggaggacaaagccatcctggattgagaaccactgggttaaagtaagtaacaggatcagcacagctcccagggcaggggctgtataagcgtgggaacggcagcaggctccctgagggccaccaatgggacagtctcccgcttcaggatcacttggaacttgccttgagatttgcaggacacaacccacaatccccagatcttttttttttttcttagagacagaggttcactctgttgctcaggctggagtgcagtggtgcaatcatggctcactgcaggcttgaactcccaggctcaagggaggcctcagcctcctgagtagctgggactacaggcacatgccaatgcatgcccggctaatttttatttttatttttgtagagatgggggtcttgcaatgttgcccagacttgtctcaaactccagggatcaagtgatcctcctgccactcagagtgctgggatgacaggtatgagccacgtgcctggccccccagaaaccttgaatcccttgtgttctaccttatgaagtgagtcccaggtgggggtcagaagctggcatccaggtccaggaccccatggagcgttacctgtgactttggatgcttctgcacacttgttgccaacttgagatgctgaattcaaaccaccacagagctgctccccgtaccaggtgagaagtgtgggaaaatggtttgaagccacgtggtttgccctgggcagtctaacgggcaagacatgaatgcacatgtgtctaggttgggcactgcaaaaaaagacgccacatctaagggcaacagggcaaacatactaacttgcatgagtggcagaggtaaagattcatgggctcccgcctgagtcctggagcagcacaggagagcccctgcccacctaaaccagtgctggcagccccagccatgccacaggcttgggagaacacgttcaccctgtgctgcaccctccgctgcccaaccccaaacctacattgtggcctcggtgtggcaggctgctggcgggagcacacgcggcatctggggtagctgtgtgtgaagcacagagcgtggcacctgtgtgtgcagcggagttcgcctgggaggaagccacatagcatttgcctgatttcttgtatgttgcatacacgctggatgctgatttagaagggctgtttttggttggtttgtttttaaaggatacattttcacatctccatctctgtagccatgacccaaaacaaaatggaacgtttccatcaccccaatagttcccacgtgcccttgttcctcagtgatttcacccacctccctccacaccacctccccaggtaaccaccaccctaactgttattgccataaactgagtttgcctcctgttctatcgttttatataaatggactcatatatggttatcttttctgtctggcttttcttcagcaccattttacgagattcattcctgcagctgtgtatagccatcccttgactttttttttttgcaaccaagtcttgctctgttgcccaggctggagtgcagtggtgcgatcctggctcactgcaacctccaccttcccagtgcaagccattctcctgcctcagcctcccgagtagctgggattacaggcttacaccatcatgcctggcaagtttttttgtattttttagtagagatggggtttcaccatgttgcccaggctgatctctaactcctaggctcaagcaatccacccgcctcagcctcccaaatcccttgtactttttattggtgtgcaatatgataaaaagaagcttggtttatgaaactgcagttcctaactggatgctactgtttaaggcccagtgccagagcccctaccccctccttctctccttccccgaactccgtctttacactttggccatgaccactgtcacccaattcacctagagtgagcgtcccattccgcctcagtcagcccccagggccacctgtgattgttcaggctgtgcaatgccatcctgactccaacaatccctgggggagaggtgacggatatcctaactaccctgcttcgattatgatacatggtatgcatgtaccaaaatatcacatgtaccccataaatattgtatatcaaagatggagaattactgtaaaaaacaatgaccggaggaagagaagcctttttccagtttacaccctggccgtgtctggctggcagcagattctccacttcccacagccagagccttttaaaaactggtttggccccaatgccattgctgcagctggaacgggtacagctggctcatctaggatagaaagtgcatggccagctttgtgtgaaaggagaggaaactctccccctgcacgtagctgctgctgctggattccaaattccttgtcctgtcctcctatcttccccatatcctgccccaacttatccttgaggcactgttccactgcagccctgcccactcccgccagagccatgggcacaccagccaccacccttccagggaatgcagtgcggcagagcacataggccacatcgctggccgttcagccacctcacgcagcctcaacttcctcatttgtaaaatgggcgtaatgacagcaactagctcatttggtgggaaaacataagatcatctaggtaaagtcctggcacagtgcctggtgcacaagtcgtcactgaatattaccttttggttgatctgtgcaggacagttccccaggcggccttgggccaacccatcaacccagttctccttgcctgccccccacccctgcccacctcccccgcaactttttttttgagacagaatctcactctgtcacccaggctggagtgcggttgtgtgatcttagctcactgtgcaacctccacctcctgggttcaagcgattctcctgcctcagcttcccaagtagctgggattacagatgtgtgccaccacacctggctaatttttgtatttttagtagagttggggttacaccatgttggccaggctggccacgaacgcctgacttcaagcgatccacccgccttggcctcctgaagtgctgggattacaggcgtgagccacaatgcccagctacccacttttttgcttaaggttctcaggactaacttggcgtgtgctgggaatgcaatatcctgagatacgcaggaactggctacaacagcccaggctctattcctctttcccctacaaacggggtatccttaggtgttttagcccagcctatcgtgttgcccctgaagtatacaacctgggctgggctgtcttttggggtatctcagatgtggtacaattggggcacacacacagagactccattcaccccgggcagatttcctgagcctgggggactggcttacaatgaatcccaggcttctgttgtcccttgctgcctgtctgtaagtaataaacccatttcatttcatgtaacttgtgtacgtgggtgttctatctcaccagattcaggcaagctgctcaccagcacacagaaactctgctccacaacctgggatctagttgaaactccggcactagtgccaatttgagagggctcaatgtctgggtaaaaatacacttctacccctgtccttcagtttccccatctataaaagagatggtatgcctgtaatcccagcaccttgggaggccgaggtggatggatcacttgagaccaggagttcaggaccagcctggccaacatggcaaaacctcatccctactaaaaatacaaaaattagccaggtgtggtagtgcatgcctgtggtacaggtaacccataaagtcacttccaaacctcacattctataaagctgtgattcccagaggctgagagctcaccaccaccttttttgtactttcattttaaatatttaaatcttcaatccatttgcgagtgactttagtgcaaagtatgagccatggatctaagtttactttttccccaaatggttgcccagttgtctctttgctatgtattaaaggttccatttcacctttttgagtgacactcctttaattagaaaattgggtccatttctggattttaaaaatcttattccattgatccattgattttagtgtagatttttaatacaatgaagtatttttgtgggtgaagcaacctctagtttctttctgaaatattttagatgtataaacagtacagagagaatataactagcacctaggcaacctccaccaatcttaaacttcagtcagaactcaactccccacacacagttatagtcaaagttcccatgtgcttcattctgccagtttccatcctcctctgaaagtagctgcttcgagtttgtttttttaatcatttccattatttaaacacaaatgtaaatatccacgatatataatattgctttatgtgttttagaattttatgtaaatttctcatactataaatatcattttccacttacaggtttttgagatatatgtaatgttggtatatgtagcttcttattctcatggctctaagaattaaatgagataatccttgtatgcaattagaagtgtctggaatgtgataaacaaggttagctgtcattatcaatgtcactaatcattatttttattatcaccattcccaccaaagggatcagaggttcacacatgacattgttgaggagcagcaaaatggagccacgatttcttttaggataacaggagccattttccctgctctgaggtatgtttggatggaaacattgggctccttgtcagctgttccctggtgctgtgcacagcttgcaggaacggctctgattttgtttaatgactctgacaagaacgccagacttggccatgtgacttgctctagccaatgagacagcagcaaacattatgcaagcagaaacttgaaaagtgcttgctcattggccttgccctctcactgctcttggtcagacccatcaccatgagaacaagcccatgctagcctgttggatgatgagagaccctgcagagaaaaggaaggtgccccagctgacatcagaaagccctgtgcccatccagcagccaacttcagatgtacgagtgagttccagctgagataaaccaaacttggcgaaatcgcagaactgcccacatgaacctaccccaaactgccatcccacagagctgtgagctcaataaatagttgttgtattaagtcacagagtctggggtggtttgttgtgctgcataagctagctgatacacctggttatctgacatctccagcaattactgacctgtatttgcagacttaactcttggttacatgaccagaaaacaatattccacgtgcatgaaccacaatccacaagagacaggctccctttcagaaacatcaaacgatgttcaacatttggcaggtctgaaaagctctcatccataccatgagtgtataaaacatgccttgacccatgataatcaccaaggggcactttctgggggttggtgctatcccccccaaatagcagactcttcccaagggaatcacaggtgatgtataggtgtttctaactggtcctaatcccaaatccatgtctgaaacctcaccttatacctacatattaacttcatgggtgcaaacaccacacctggtcataccagaaaccagagttcccaaaaagggtaaatgtccttctgtacacagcaaaggcatgttgggccatgcctagaggaaaaggaggcagaggctgcagagctggaagctcagctgttttgaggccctgggctgacagatctttgtccacagccttgccaggaaatgccccacagtcccacatttggaagtgaacaagctggaagggtgattttccaactggacacagctggtgacgatcaagatagtgaccctggataactgccctcagactctgcaaggccaattctcaccataggtggagttatttgcctgcataagcgatggtcaggccctctctcctgcccccagacacagaggagggaccatgcgcttcctgacattgtggcttcaaatgccacaaccacaagggccatccacttagggacaacattggtgtctgcctcaggaagtcccttcccactccacctgcctgggaacacgccctctgatgtgacagcttctggactcatgttataaacaagtccttttttaagggcctgaaacattggaatagaaccaccaccaaccctggaaaaaaaatgcaaatccaaaataccaagtactatacaaaggtgctctaattattcttggttcaaaatgattcacaagaggaaagggaaccgactccgtatgtacgcgtgtctatctgagaaagaataagagacgctttctctatgcgcatgcttcccaaaaattaatgaatgaaatctctcatcctagtcctttacagatttatctaaggtttcttcctgtgtttgaattcctctattagaaaaaaattaatcaaagcaatacatccctatggctagaaattaaatatttacggacctattatagaaagcagtaatttgccaccccctctctccacaccaacgcaactctcacagtgtaattcctgatgactacctagtataactctaagtaatatatttataccattctttcttgatttatcagctctgacattacttcttcccaaattcctctaaaggttttgaaagattactttgattccaccccccccttagaaacatcacacctttaaacaatgcacttaaacctcaattaattgagcttttctattataacttttgtctccctactgctattgatgaacttaactcccttctacctccccacccttctttcattttatacctttctatgtctgttagctgcatcataactttcacctgtaattaactccttaattgccaggcactattctctgtactggggatacagccttcgagaagacaataacattccttctgtcatggaaatgaccctttaagggaagcagagaataaaaatataaggatgtgcagaagataatttctgagaatgaaaacacactggatataaacaaacagtcacgtgcaagagactatacatagaagcaggaagctcaaaactaactgggggccgggtgtggtggctcactcctataatcccatcattctgggaggccgaggcagatggatcacctgaggtcaggagttcgagaccagcctggccaacatggtgaaactccatctctactttaaaaatagaaaaaggtagctggccatggtggcacgtgcctgtaatcccagctactcaggaggctgaggcaggagaatcacttgaacccgggaggcagaggttgcagggaggcagagatggtgccactgcactccagcctgagtgacagagtgagactgcctcaaacaaacaaacaaaacacctaactggggaggtcacagaaggtctcgcccagcagacggcacttgagctgaagccctgtgaatcttaaggttgtccagtctgactgtgggagcagacactgttcctggtcctgagggagcatgtcttcccccggtctcacatagttccatctcacacatgcactgatcagcaatctgccaagtaagggagacactctgcaaacacctggggtgctgtgtgtaattctcttctctctgggactctgtcctgagaaatctgcctaccttggttttcccaggctctcagccagtgtcctcaactcacggattctgccaagttccctgtctcggcactgcgacctgaaaactcactgggtcaattgtagactgtattagcctgggctgccacgacaaaagatcacagacagggcggcttcaacaacagacattatgctcttccacttctggaggctggaagtccatcatcaagatgacagcaaattcagtttctgttgagaacctgccccctgctggtaaatgtccttccatgactttactctgtaaaaagtctttactctgtaaaaagtctttactctgtaaagtctgtctttactctgtaaagtctgtctttactctgtaaagtctttactctgtgcttgcactggggaaaggagagatttttagtgtgtgcgtgtgtgttttagttaaagaggcagggtctctctcagttgcctaggctggtctcaaactcctgggctcaagcaattctcccatctcagcctcccaaagtgcttggattataggcgtgagccactatgcctcacctcttccttttcttataaggacaccaatcctatctgactagggtcccacacttatgacctcatttaaccttaattacttccctgaagaccctatctccaaatatatttatattgaaggttaggacttcaacatatgaattaaggtgggaggggcacaattctgtccataaccgggctcactccatttgtctcccacttctcagcgatcactgtcctttgttgatcgatgtacagtgtcttgcaaaccattgtttagtcccttcttttgttgatccagaagggaagttacctcttggctggtcttagattttcacatttatatgcataaaatagtctcaatatttttttcgtttttgttttatggtcatttgcagtattttgtatgttcctgcttttttattacactagctagtattttttttcatagaaacaattcccagttctactatttcctttctcttttctgattattctaggtacttgtgtttattaattctcccttccacatcttttcattgatatttgttttgttttgtttttgagacagagtttcgctctgtcacccaggctggaatgcagcggcgcaatctcggcttactgcaacctccacctcctgggctcaagcgattctcctgcctcagcctgccaagtagctgggattacaggcatccaccaccatgcccaggtaatttttatatttttggtagagacggggtttcaccttgttggccaggctggtctcaaactcctgacctcaagtgatccacccacctcggcctcccaaagcgctgggattacaggtgtgagtcactgcacctggcccttttcattgttatttttattgttgtccatttcttaactgtgagttgaaaattaaacttttttctttgtaatatatttattgctatacctattcaatggtaggagttcttagctaagcactgtattggctgtgtcccccagtgattctggtatgtttttattcataataaagcttttaatttcaataaaacatacatccagaaaatgcacacgtcttgagacagctgacaaacctattacaaagtgaatatactcatgaaaccaacacctggatcaaaaataggacattgccagcatcctaaaaattcccactgcgccacttcccaatatccctccatcccccaagcaacttctaacacaatagattacgaatgtttttgaacattatgtaagtgatatcatgacggagtctcttaggtctgtctagtttcacccagcattatgtttgtataatttgtccatgtttctgcacgtagaagaaaaatctgttacaatgtttttgttatgactgaaataaatagaaaatgcaaaactgctccttaaaatctgttattacaaatgttccaagcagatttcatgatttggtgaagaggttgaatagcttacccaataatatgcaacagattaaagagaggaagtactccaaagtcacatcacaaaaatagatgcctacataagtggaaataaactaaaaatttaataattgacataacctttacacaatctgtattattttgactttcaaaaaattgctaaaatgaagtctacatttatcaagtttgctcatgcagggattatgcacaataaacatacatccccttggttaggcatggtggctcatgcctataatcccagcactttgggaggccaaggcaggcagatcacttgaggtcaggagttcaagaccagcctggccaacatggtgaaaccccatctccactaaaaacacaaaaattagctgggcatggtggcaggcgcctgtaatcccagctactcgggagggtgaggcaagagaatcacctgaactcaggggcggatgttgcagtgagccgcgatggtgccactgcactctagcctgggcaacagagtgaaactccatctcaaaaaaaaataaataaaataaaacaaaaataaaataaacatacatcctctttatacaatgcttttggagagagactgatcgtatgatgcaaatcactccagactgggaataacagttaaatttgagtctctgtccatcagtgataaacaagatgaagttaattagattcaaatattttattttcaagcataaaataggacattcacaagacacgctgaggttttttttctagctctaaaacataacatgatcctaaatatatttagacaaccaaaaatgatatcagagacatgagaaaatctggcaagatagtgatttcaagaggtggacccagctcaccctctgtattcattttctactattttactattaaatttcctggtattaaaaattaccaaaacgtagtggattaaaacaacacaaatgtcttaccttaccttattatctcatagttttgtgggccagagtccagcaagggtctcactgggctgagattaaggtgtcagcagggccgtgtgcctttcaggaagctgtaggagggtatctgcttcctggcctcttccagcctccagagacccccttcctccatcttcaaagccggcaacatagtgtgtaggtgaccctacttccatcaccacatccctttctccgaccgcagctgccactggttgtctgctcttaaggagccgtgtgattagattggatccacctggataatccaggctactcgccccaactcaaggacagatgatagcaactttagtcaattcccttttgccatgcaaggtaacatgctcacaggtgctggggactaggacgtggacattgtattaggccattcttgccttgctataaaggaacacctgagactgggtaatttacaagaaaagaggtttaattggctcatggttctataggtttacagtttcaaagatggcatcagcatctatccagcttctggggaggctttgagggggcttttactcatggcggaagatgaagggaagcagtctgttacatggtgacagcaggagaaagagagggaggtggagtgggagggaggggggtgccacacacctttaaacaatcagatcttctgataactcactcactatcaccaggacagcaccctcttttccacaatcttgatggagtaactccaattctagagctagcaggttagtgaagcttagaaagggcatttgattttgtttttaatcatccctatccagctcctgtcctgttccccaaatctccagggctcaaagcctagatgatcctttatttcctataaaacaaaacatgcgatggcaaaagctcatgtctccaccaggccttaagaccaaggacttcctgggctccctgagggagtctgctcagtggatgcttttgaattatctataccagggactggcaaaccttttctgtaagggacagaaaggaaatattttaggctttgcgggccacatggtatctatcacaactattctgttaccagatggagggccttgagtgtgagttgtccgggtcctcagtgttttgaacaaagaattggacaaaacacacaaagtgacaaacgaatgaaacaaagcaacaaagcagtgaaagcagggaatgatattttattttattcatttatttatttttgagacagagtctcactctgtcgcccaggctggagtgcagtggtgtgatcttggctcactgcaacctctgcctcctgggctcacgccattctccgaaagcgagatttattaaagtggaaagcgctccacaggtgggagtgggcccaagcaagcagctcacgggcctggttacgaagttttctgggttttaacgactccttttgagggccctatcggctacaaaaatgagtaccaaactcatgtcttgctttatagaaaataaaggatcatctaggctttggatcctggagatttggggaacaggacaggagccggatgtcaggtccacaactacgccaaatgtcctgcttggggtcaggttcgggcccatactgaggtccaaggggagtgggcggatgggcagataggtgaaaaacactgggcgggtgccataggcaggtgaaatgtagttttattcagcagctctctcatcaacagctcttacacactcttctctcatcagtagttttctcacaccgtccgccctgttttagctgcttgagtgggctgctcccatacaccgctgtgctgccggctctcccttgccttcagggtcagcagcttaactctttctctgggcacaagctggttccgggctccccactgcccacctgcaagacggacagctttggctctctcttcctctgggcaccagcgcacccaaccacgtcaagccatgcccaagagccaagcccagccatgtccccagagccccgtgcagtgtcagcagggcagtcataccttttacagacaatagtggcgtagagccaagtatgaacttacacaaacagttatataacaagtggaggtgtgagcctgcaccccaaccctgctgagtcatgcaggcctggatgtctgcctcggcctattccttgaccaaagcacatccatgtgaaggaaataatgtatacagtggtccatttccaagataaagtgccttgaattggcttaggtcagcaaactacagaagaaacaagatatactaggcccctgcttggatagccgatgcctgcttgtcggcctctcccttctccccttcctcccttgcttagttgccctcactcaaaccaaagacatttagtctaaaatgaaagtttactagcctgcaaaatagctcactttgtcagttcttatcggcctgcccagctacttaggtcattaggtcataagacaaatgcttaaaaagcccctgagctaactaggattgcaatacattgtgggctgcaacaaaatgccacaagacaaccctaaaaaagaacacctaaagcccctacccaccatcactaggcaaagtccgggaagagtgtgaccccacagtactcagcctttgaggaaccggtggagagacctgtgcactagaggatgaattgcttgttgtgactgcgctgggtgtgcctgctcattagacacccagtcttgcaagaccgtcattaaaagtctcactttcactattctctgggtctctaagtccattcttgagttcgaacgcatgaatttgttcctcacacatgtaccttacactggatagggctgattaaaaacaaaatcaaatacaccttctaagcttcactttcctgctagctctagagttggagttactccatcaagattgtggaagagagtgtggtaggaagaataatggcaccgctgaagatgtccattctttatctggatgaaggatttggcccatggctaattaaagctgaagtgaattggtccgcagtcatctggagacggagtggatcggcaccctacgcagatggggggatggctagcacttggcccacagccaatccaaggcactttcctttccatctgagacatggtggaaggttgtatggagagtaacctttgattctttgttatcccagcatggcaagatggagtttttccttttggcttagcttttggaagtgggtgttaattggtcttagagtccctgcccccagacccaagtgtttcccttttgatccagccttaggaagtcagcacacattggccttaagttgcctggtccaaaccctattctcctgcctcagttcaatctgtcaatatgaaggttgaaaatacatcattaaatgagcatagctgtgggccaatagaactttattcataacactgaaatgtgaattttacatgatttttcacatcatgaactagtcttcctttgtttcccaccctaaccatttaaaacagtaaaaaccagctgggcatggtggctcatgcctttaaccccagtactttgggaggccaaggtgggcggatcacttgaggccaggagttcgagaccagcctggccaacatggtgaaaccctgtctttactaaaaatacaaaaattatctgggcatgatgactcatgcctgtgatcccagctactcaggaggctggggcaggagaagtgcttgaacccgggagctggaggttgcagtgagccaagatcccaccactgcactccagcctgggtgacagagtgatactctgtttcaaaaatacatacatacatacatacatacatacatacatacatacatacatatgtaaaaactgttcttagctcaaagaccaaaaaaaaaaacaaatcagacatcgggccagattttgcccaccagccatgttttgccagcctctgatattcacaaagggctgtcttctgtctgctgagtgtggcgttatttggctcaataccatggacctgaagcaggcaggactcaaatctctgcagctgggagagtttttaaatgcagctacaaagttttcctgaatattagatatatttgcaagttgccagcttgttagataagcactcacagggcgttctgctcgctgctagtttgccctgatcaacacttttatgtcgtgacctataagaaagctcagagaacctagtggccaggaatagcaaaggaaaatagttacgagaggaggtaattaccctctctaccaccaagagatagaggatggagggtggaggttaaaagggtgggccctggagtcacggtaaattactcggggtaaatcatgtaaattttctggccaccagtttcctcatctgcataatagggatgatgatagtgtctgtctaattatatcgttgataggattacatgttatcatgcatttaaaagacttagtgtctgcttgttagtttttaagtggttggttttcactacctccactattaactaccctggcataaaaaagcaaaaggaaaaagaaaggcaatttgtacaattaactcctaaagaaggtgaaagagttagtggaagagatgagaaaactttaataacaaataaataagaactttcaagaaaatgcaatttgggtttgatgactttctggaagtaaaatgtttgaaaaattaaaagaaatatccaatagttggactggaataaatgggaatcatggtatagtaagtgataggacatctcctcatagggatgaaagaacaggtagaccaggggaagggaggacatttaggaggcaggtgcaaaacaccccacgagaatccaggctgcagggaaatacagaattagaagagttggacaattaatcctatttgagaggataagttcaatgagctgaagactgatttttttttttttttttttgagacagggtcttgctctgttacccaggctggagtgcagtggtgcaatctcggttcactgcaacctctgcctccaggttcaagcacttctgcctcagatttccaagtagctgggtttacaggtgcaccacctgtaatatgccaccgcacctggctaattttcacatttttagtagagatagggtttcacaatgttggtcaggctggtctcgaactcctgacctcaagtgatctgcccacctcccaaagtgctgggattagaggcacgagccactgcacctggccggaagtctcaaattttgacaccgaaagagcacgttgtttccaggactggattaattcctaaagaactcaccttagacacatgctctgtttaaattctgaagactgaatcttaggagaaaatctgacaagacttcagagggaaagaaaagaagagtttactcacaaaactaaaagaataagtaatggggaaaggactccctattgaataaatggtgctggaataactgactaatcgtatgcaaaagattgaaactggacccctttcttacactgtatacaaaaatcaactcaagatggattaaagacttaaatgtaaaacctaaaactataaaaacccaggaagataacctgggaaatatcattctgtacatagcttctcgcaaagatttcatgttgaagactccaaaaacaattgcaacaaaaacagaaattgacaaatgggacctaatcaaactaaagagctctgtacagcaaaaagatattgtcaacagagtaaatggaaaacctacagaatgggagaaaatatctgcaaactatacctccaacaaaagtctaatatccagaaactatacggaacttaaacaaattaacaagcaaaaaacaaccccgttaaaaagtgggcaaaagatatgaacatttttcaaaagaagacatacacatggccagcaagcatatgaaaaaatgctcaccattactaatcactagagaaatgtaaatcaaaaccacaatgagataccatttcacaccaatcagaatggttattattaaaaagtcaaaaaataacagatgctggagaggttgcagagaaaagagaatacttatacactgctggtgggaatgtaaattagttcagccattgtggaaagcagtttggcgacttgtcaaagaacttaaaacagaagtactattcaacccagcaatcctattattggatacatacccaaaggcatatatataaatcattctaccataaagacacatgcacatatatgttcattgcagcactatccacaatagcaaagacatggaatcaacttaaatgcccatcagtggtagactggataaagaaaatgtgatacctatatgccatggaatactacacagccaaaaaaaagaacaagattatgttctttgcagcaacatggatggagctggaggccattaatctaagtagacttaacacaggaacagaaaaccaaataccatgtgttcttacttatcagtaagagccaaatattgaatacacatgaacacaaaggagggggcaagagttgctggggcctacctgagggtggaagttgggaggagggtaaggataaaaaaattacatatcaggtcctatgcttattacccgggggatgaaacgacctctacaccaaacccccatgacatgcaatttacctatataacaaatctacatgtgtacctctgaacctaaaataaaagtgtaaagaaagaaattgtatacctttaaagcttattcacaattatgactctcaatatattagcaatatattaaacatatttgtttttcaataatacatatgtagaaattaataatatctattttcacattcaatattgtgcattccttgcactgcttgcccctgattttggagattaatgctgcagaaaatatagagccaaaaaaggcataggtaagcaacagagctgcatgatcgcatctgtattctagaagtccactagaagagtggaggaggacaaattcctagaaagacacaaactaccaaaactgactcaagaagaaatagataacctaagtagacctataaaaagtaaagaggttgaattactaatgtttaaacttcccataaagattcaatctttgtaggtcacatgcttctaggaagtcatccatttcttctaggttacataacttccaggctacataacaaaggaaataattatcagactgaagaaacaatccatgaattgagagaaaatatttgcaaactataaatctgaaaaggggctgatatccaaagtatataaggaattcaaaaactcaactgcaggaaaacaaataacccaattaaaaatgagcaaaggttctgaacaggcatttcactaaagattagatacaattgcccaacagatacatgacaaaatactcaacatctctaatcattaggaaaatgcacattaaaaccataatgagatttcacctcacacctgttggaatggctattaccaaacagatgagtgacaagtgttggtgaagatgtgaagagatgggaacccttgtgtactcttggtgggaatgtaaataagtacagccttttggaaaacaccttgaagattcctcaaaaaactgaaagaacacctttgtcctctaacaaaggtgtcattgtgaggtccatcctctgtagtcaaggctctctgggtctgtgaatttatttaggtctgggaactaggtatgaagccgtggctttcttttgcagtgactcaagttagacttttgcctatcaaacctacagtttgtccagtaatactttagcagatggtccagctatttcatctccccaaggataccaggattgattagctcctggtaaaaatccctgcatgtcaaaccttctgattgctattggttcacgttgcccatacagaacttgcactcaccttgtctgtgaaagttaagtactgccacttaccttctaccaccttgagatcttttcactcttattgaaatcaggaaaaaatagtttttacaacatagtggtgccaattatgagccattaatgagctgtgtaacaacctgggaatccaggtgctatggtttgaatgctgctgtccccctcaaactcatatgttgaagcctcattgccaatgtgacaatattaggaggtggggcttttgggagtgcttaggtcatgagggtttcaccctcattaatgggattagtgcccttatgaaaggggccacagagagctgccttgccccttccaccatgtgaggacacagagcgaaggtgccatctgagagccagaaagcagtccctccccagatatcacatctgttggtgccttgatcttggacttctcagactcccaaaccatgagaaataaattgttgtttataaggtacccaggctgtggtattgtgttacagaagcccaaaaggactaagacaacaaaaatgaacaaaataggcacatccctaagtgcacggagtttacagcctactggcaaaggcagataaacaataaccacactaataattgtatttaacgggtctgagacagagagctgtgtgccaggaatcatcctggaaggataggtaggggtaaaatcagagtcctctccattccctctcttccaaactcacaatgcttttgtgtattttcacagcctcctgcacatccctctgtcctggcatgtttaatgccaggccatcaggtaagacattccaggtcttctttcctggagtataaggactatgcctcttgtatctctttaatccaagtgcccatgaaaggttctgtaagtcattgacttccttaaatattttaaaaaataaatggaggaacaaagagggagaagttaaaccaccaactggggaatgtccaggtgttcatgtctaagaaaagagtaatcactagcttttctcactgtctctacctggatatagggacccaatccaagtagatactaagaaagataattctactggctgatattagataggattggggggaagaaaagatgaggaaagaagagaacatggggaaaaaactgaacttgtgaaatgaaataatgagtggagttggagggagggtccttggtgagtatcagtgcagcccaaaaggatcaggtagtctgaagggataatgtcatcatggctggagactggacactcataggaaccccctcctctgactgtatttttctctgtgacttctcctgcggtggtagattgggattttattcccaattcttcactccgtataaaagaataatacggccaggtgtggtgactcatgcctgtaatcgcagcactttgggagactgaggtgggagaacagtttgagcccaggaatttgaggctgcaaagagctatgatgtaacactgcactccagcttgggcaacagagtaagaccctgtctcaaagaaaagaaatcatatgtccacttttttgtggtaagtacctgcctctagatttggaagagtttacttcccccacaccactgttgttgggctcaggcatgggacttgatttggccaataggatctaagcagacatgataggagcagaggctttcattcctgcacttctgccatccaccgtaagataaacatgctccgttggcactggtcccaacatgagaaacaactggaggaaacctgaacctttcccttagcctgaagcagagccaacacagtcaacccacagatctatgagcaagaaaaaaaatggttgttatcgtgagggttgcttgtcatgcagtattatcacagcaatattgcactactacacttgctttcttttttgagaatttcattccactctcccttttctgcttaactttcatgtatctcaaatgatgttataatttctttttatatttctgatgaggctcagggatctccttttcccctcatccacatacctaaaaaccaccttgtgcacataaccaatcccacccatttgtaatgggctctgtacaaaggccacattaattgcacccccctcatccaccactcccccattcccacacacatacccatgctctgccaggaaacctcctgtgtagagaagcatctggggtatgggaagagctttggtgtgtcagaaagatctcaacaaaagcatgaagtttaagagacattgtgtaacctgccctggatcatacattttaacagttagaatgtgtttggccccaagtaacaaaaaacctgatgaagaggggcttaaatcttgagaacagttattgtttacttaacaagaagtctggttgtagatggttcaagagttgattcagtagcttcagaatcaactgggttggcatcttggcaattctcttgaccttcctttcatggttgtgaaatggctgccacagctccaagcatcagcacccacgacccccaacctgcatccaaaagcaagaataagggggaaagccaaggtagcaagagagactttgtttgctttcatctcttcttttatcatagaagaaagtctttctcaggaaaccccaagtgagctttcccttatgtttcgtggacaattacgtctcctggatcacaaggctactcctagatgcaaaggaagctaggaaatgagttttgatcatgagttttgctcacgcctctgtagtggaggcagagataggagcagggttaggaatggctgttgggtatgtggtagagaaagagaagcatcatgcatttatcccttcaagaaggacttgcttctctgcagtgggaagtgtggtcagcagacaacttccagttgtcagttccttcagggtctgccccagcttcagagagctgtctcacccaaggtcatgcccttcccagagcagcccatacccagtttattagttcgttttcatgctgctgataaagacatacctgagactgggcaatttataaaagaaaggtttaatgggactcacagttccaagtggctagggaagcctcacaatcatggtggaagacaaggaggagcaagtcacatcttactagatggcagcaggcaaagagaggaacttgtgcagagtaactcctctttttaaaatcatcgatctcatgagacttattcactaccacgagaacggcacgggaaaggcttgcccccatgattcaattacctcccactgggtccctcccacaacgtgtgggtgggaatttaagatgagatttgggtgagaacacagccaaaccatatcacccagtaacagagcaagggaggggtataaaagcccaatgggagatgctctacaagcaatccttgctctggagctcccactgggttggactttgtcaggcctgcatcaagttagacttcttcctctgccctgttctgcattttcctccttcctttcacaggttttgatccctaataaacatcttgcagcttaggtgactctcagtgtctgctcctgcagaatccaatcagtgatggcatcttccacatacagcaaagaagtgatatagccaggattagaaactaggtctgtccaattccaaagccccaacccatccccactccccaaccatactgcctcttatggccaccatatccatttcctcaataagcactcactgaatgtctactctgccccgagacctaagtgggacaatggggatggtactacaggctgtactgtcttgtctgtttaccaaaacccacatccttctcttctccctgaggacacatgtagtccgtatttcccagcctcccttgaagctagttgaggccaaacaactgagctctggctagtggaatatgagcagaagtgatgtgtgctgttttcctggtgaaagtttttaggaagcaaattccatcctccatactctctttccttttcctttggcagatgcagagaccaaaaaagccctaggatatgtagaaccacagatggaaaaaacctgggtccctgaatcattatgatgagggacagctattctatgacaaacttatatggtgtatagcaattataaactgtggagtcaattacctcagccaagcttacactaactaatgcatggatatagagatgaatcacagatagcccctctcttaaggaactcagtctagtggagaagctgtggataggaagagatacagggttgtgtagttagcaactgggccttgagggagaggtctgatttttgtcctggctcctaggaagtaatttctaaacccttaggatatcctgattaacaggagtgtctttgttattcatggtgggctcctgggaccacaactcacagcttatgctaaccagatggcttatagtgagtgctggccatgccagaaaaatcaaccacagggttaaaagattggggctttgggctatgtgatgtcagcctgacctttgggtgtggggaggggtatggaggttaagttcaaccatgtgggaaatgattcaatcaatcacctctacataatgaagtcccaataaaaactctggacactgaagcactggttagcttccctggttggccatactttgtcatactgttacttatcaatgctggcaaggtaacagataccgaggacacgggtgtttagcatttggaaccctcccagattccttcctatgtccctttcccttggctggttctgattcgcattctttgcttgtaatcaatgtgacttgagtagaatagctttcagtgagttctgtgagtctttctagtgaattattgagtatgaggataatcataggaacccccttgtttgtagccagtcagtatgaactgatggtggccctggagatccccaaacttgtatctggggtctgaagggagagggggagattgttccctcagactttgctgactttacagcctcaagattgctgactttacagcctcaagatgtaaatagctttaaaaggtcactaagaagtgactgtataccattgcactccagcctgggtgacagaatgagactctgtctcaaaaaaaaaaaaaaagaaaagaggaagaagaagtgactgtaatgtaggcacctggtcaagacagcctggagtgaatggtgaatgttctgacacatgaggtgccctggcatctgttgccgtacatgagggtctcacctgcagttggtctgtggacaaaatatgactccccgctcagtccaggctctgtcactgacttgctgtgtgatccttacaaatcacgacactctctccagacctgtttccccatatgaaaaacagggggccagatgagctgatatcttagagtgcctccatctctgacaacctaaggagttatttcctcaagcttcttcagagaagaaggaaacttccttccctgaactccttcaggaattctgaatcatcacatccactaatatccaatagacaaatgtcccctgccacatccctgttgactagcatctcccctcagctggctcatctgcagtgatgggaagctcactctttcatggtgggagcagtgtggttctgtaaaagagcacagctctgggtttcagtcccagctctgtccttccctctctgtgataccttgaaccaatcactccatctccccaaggctcaattttcctcatctgcaaaatgggtggacgaatacctacaccatggagatactgcgaagaatggaaaatagcagtgcatttaccatctgctcacaccatgctgggaattgttctaagtgctgtgttcatattttctatctgaagaggcaggtaacatggtattcatcacccccagaaaagtaagaaagttctagatgttaagggacagagccaagatttgaaccagcaaccatgttctgaaccacacagctgttctgccaccacatacaggaggtgaagggcttagcacagggcctgacctacggccacctgactccattgagtgtaccagcaagacaggctgagagagtgagggagtgggaactggcctccataggcatagtcagagttttgcacaaaacaagaacctaagagctattttaatttcagcatacatgcaagttttatgttttacagtttaggtattatttgtattctgagtcacttatttgggggagagcatcttcatatcagtttttcaggcatggcacctccaaaggtcatcatctgggcctgcatctctcccagaacagccaggtcttctgtgggtccatcagattatgaaacttcccttcttgcccgaatcccaaatctgactcccacggttcctaggtcccctccctttcactgccctggaagagtcctgcagagacctcaaggcagtgggccagcattgcttttaagttcatgcatggtacaaaccaccttaaatgcattccgggcatggcaggagacccatcagacttcctagagctgcctgtggtcaagattagaagaggaggcatcggcctggctgtgtcctacccttgagccaacagggggtgctgtctccgactaaccctacctggctctgagtctccaaacctggggctcaggaagccgcctcctttgcacaccatccaaagtgagttcaatacagccacccctgcccccaactcatccaacacacacacatacacacacacacacagacacaccccatctgcagaccggccaactgggctggctgcccacctgctttccctctgtgggtttttatcaaaggctacagataacaattccctccccatttccactcccacctcccctcctgtgcttcctccaagcccatccttcctggaatcccagcatcattccagagttttgaaaacttttgtgtttttttttttttccagatggagtcttgctctgtcacccaggctggagtgcagtggcttgatcttggctcactgcaacctccgcctccagggttcaagtgcttctcctgcctcagtctcccaactagctgggtttacaggtacgcgccaccacacttggctaatttttgtattttcttttttagtagagatggggttttgccatgttggccaggctggtctcaaactcctgacctcaagtgatccacctgcctcagcctcctctaacgtgctggaattataggtgtgagccaccatgcccagcttaaaacctctttatcaccataatctatctcatttgagcctcacaactgcattgcctatgaggaagaccatggggcagggattagagtctcctcagcagaagaggaaactgaggcacagaaagagggagtgagggagcacatggcccatcagtgatagggctgggttgggtaggggagccaggctcctgaggacagggtgtgcctgaactcgagcctactgttggttgagggaccttcttctccaaccccctcgctgggaaccaccggctgtgagagtaacttcatgggcagtacttattcctaaaaagtcaagagaactgctttcctgccaccaacttgctgtgtgcgtgaccttgggcaagtccctctgctctaagcctctgtggaatgtggcgatcccctcaggctcccccactgattgagatattctgactaaacaactggtatctgaatcacctccatccctttggggtccctgggatcctctaccaaaacgcaagagggcttgtagcagagctaacagcaccatagcgtgataacaacactcgtctccatttctccactgctttctacagcctcaacatctaatgtaatcctcactaccaggaggtaggctctgtaattatccccattttatagatgagaaaactgaggctcagagaagcgaagaaagtggctgggctagcattggaggctggggggactccacctcaaagggcaggctcttgattctattgtcatctactcatagaagtttctggaagtttgctttagaaactccactgtagaagctctatggtctttcagcccccactcaaactgaagcccttcagctgcccctcaaggatcgtgagaacaaggacacagatgggaaggacccacgtcccccagcctcttcccacccaccctccttgagccagcccctcatcctggacccacaagcacattgcagcccagccagagcccgtgagcagatgcgggtttattattgcacagactgcagcatcctgaaccccaaacccaaccccaaacaccagcccccaaacttggcctgggagctttggcaggcacaggcttgtccccagcaccagccaaaaaaaaacaacagaaaaaaaacaggacaagaatctccgagacggagcccgtcagcacagagcagtggccccgccccattcccctcatgctccaggagtcttgagaagctcagatgcagatgcagagctgtgggccatggccagctgaggatggaagaatctgcaggttcttctccatgaaaatacagtcctggattccagccaagccacaaggtcccagcagggcttgaaacggcaagtgtgaagctaagggagaaggttcccaagcattgaagggaaatgggaaagctgaccctatcagaagcaaactcctaggtcccagagctgcctggggaggccctgccacaaagccaaagcctccaaggtccacagaaatgaagggaggacagcagcagttccctctggctcagcttggatgccacgtccttccccaggcttggaggggcctggaagccctttctctccattctcctggaggcaggaaaccatagcctttggccctcaccccacccacaggaagcacaagggcccagagacctagtgtggtacaaaacatctttaagtgaggtacatccaagtagccatcttctaccaagtaagccaaaggggcttataactgcacccaggctgtacccagttggagccccagacttgcccctctcttgccgggaaatgcttcttgacaagcagcttgtcttcaacacctgccttagtgtctgccccagggacatctccctgggcttccatgggcttctgtgctcccctgagctttcggtgggccctgatgggggaggagacaagccatttcacagggcatcacaggagatttctcgccggccccaggcctcctgcaggtgaccctctagcatcccaagcacacgggaaaccccaaatgcaatcccagtctcagacacactccaaaacaggccatcatcactgcaccttaacccctcttcccaccctgccccctggccacctggtcagtggcttcccagccagaggatccatggggtctcccctcgtctattggtccagaagggaagctaactggactggtgggaggagacagagcactgtgttctgggatattcaaactgaccttgtccatttcctctactgtcatccagaacatctacaggcaagggagggagtgcagggtgcagactgcacaaggacaggtctctgtgctggtctgagggggtctcaacacccaccccacccagcttccctgggaggcctcagcccacagccaaaggattaaatcaaagtggggcagggtgggaggaagggggatgggattgaatatcaatgtcctggttaggtgacatctcccaaaacacacaaaagcccagggaggggacaacctagggaaaggcaagggagtggaggagagcgggggacaggagcagatcaggaagctcaagagaccagggcgcttctctctgggctctccttgcccctgggtagagagctcctgaaggagcccaggacattccattcctcttggcaccaccaccgccacccagcacaggcaccgtgggaggcctcctgaaactcttgtggggtgaatgtgaactggaccacggggctccaggtccagagtccagtcctctttggccaccctgcctggcactgcaaaaagacgggtcctcatgtcctcagcaggaacttctggctctgcaaagagacagcaaaagggtcaggcaagggagggagggcagaggctgggccgccaagccaggtgcagggctcaagccttggggctcatcttctctggggcaagatcccacctctgcatccccccagacagccctgtcccttgattctgatactcggcaggtcacaaacgggtccccgaggcctctcctggccctggctgcctgcctgtttatttacacatgctgttccctttgctgctgcactcatctcttccctcttcctcccccactgtcatctggttcactccttttcacccttcaggtcattaaaggaatcagtgcctgcaggaagcattcccagagcccctgttgaaacatggaacctgcagagctcaagtgttcacccctacggcagcacttaccaggctggtattgtcattgactgtttacatggtgacagcatagactttcctggggctgattaagaacctccagcccaaactaagctaggatcaaaaaagggggcctgaggaaaaggcagaaaccctgttattattgccaagcatgggattgaggctgtgaaggctagttccagcagggggaagattttgtcttgtagatgcttcaccttgagagcagtgagggccactctccttcagcccagcccagcccactccacttcacgggaacttaccccagcccccagctccatcatggggaaaaaactgagagggaaccaatgggcagaggaacaggagcaggctgggtgtgccaagggattaaagactgaagtggggaagagagaaagggagcacggagatgagtgtcccaccgtcccaggtgagctcagtctagacctgttgtgctcagtgtttgaacggtaagacttttctgtaatgagctctaagttcagggttactttcattatgttcaccccattcttggagcaggagtgagtccctgctgtatccccatctcccagcagagcagtacatgttggccaaatgaatgagtgaatgaagccctcagtgctcacctgacagagagcaggtgctctgcaaacactaagctaatgaagtaagtgtgtgtgtgtgtgtgtgtgtgtgtgtgtgtgtgtgtgtgtgtgcgctggtatcaaatcacactctaggtcttggcttctgcaggtgggtgggcctcaattagtcacaggactgtcatccaagtaccgagtaggtccctcctcccaccaccctggtgctcaaaactccccaggggctcctgccccccaacccctcctccagccagctggctgcacctggtaagcgacggtcaggtcaggaggtgaacaaagaggatggccaggccgatgttcagcaggatcaccatgcagatgaggatggtgttggggacctgggagcagtggagagaggcttcctgagtccccatggcctcggagacaccccccacccaggtcacagcaaggctggacagagcaggaacttctggatggaccttcctaagagcattgccggctttgttcactgctgtatcctgtcacctggatggcagaccatcacagctggaaggactcttagaaataaccaaatccctcaggacccagggagggacaagatcatgccccaagtcatatagtgtgtgaatcaggcctggaacccaggcatcctgctaattccccttgggacgcattcttcagtcccccaaagcccagcttcagtctttgttgccgccgttcctagctccctgcctcccataagtcaggaggtctataacccaaatcctgttgggcccttcttccacctccatgaagccctcactgctacaccttgtagcagatgctgctggtgcccagcccaacccccctgactgggcaaatggacccaccctccagctgctcaggctcccagctgcccctgctcatgagaactgtctctgccaatgggataccaggtgcaaaggtaggaggactccatgcggccatttacgctccaacgtcctctgtggaccaagccaaggctatgctcccctaatccccagccctgcagcatttcctcctgctctatcctgcttcggtctctcgcaccccagcaacccccaaatcccctgcccctgaatcctccctcaagccctgctacctctagggaacccgaccttaggcacaccttgcccgacagcctcacctcttccacctccacctccgcctctgccgccagtgcggcctccttccgcgccttcttcttggcccccgccttggtcagccctcgagcctcagtcttgcgggccttggccctgggctcggctttggggatgatgggcttgggctccagcttggcgggggtctcgcgtgcaggctcggggcctcggagcgtgggggcctgcagcggggcggtggccggggacgagggcgcggactcggacccggagacctcgggctcgggctggtcctcaaagggtgggggctcgggcggcgtggtgcgcacagcatagctgtggtagccctggtaaagcgccacctccggctcccgcgacggcgcaggcggtgcctgcagagcctcgatggccatgcgctcggtggctggacgcgcggggctgcggcggcccgcgccctcggacggagtgactgaccggctgccctcaccgctgggctcgccgttccaggcgcctgggctcagcaggccgtccttggacaccccgggcctgggccgcttgggctgcgggggcgtcccggccggtgacggggagccaccctcgggccgaggggtctcacgctcgtgcagctgcgggctctcgcggggcggctgtgggaggcccgctgcgccggcgccccggtcggggggctccagcaggctctccgagttctccaggatctcctgcagcagccggcgcttctgatattccggacctgccagggcaacacagggaggctgggctcgaaccccgcaccactgttgggtgatcctgggccagccacttcacctctcgagcctcattcatgggctcagtcggcactcacatagcactgaccaagtgccaggcactgttccaagcactttccaaatattaactcatctaatccctgtagtatccctatgaagttgatgctactgtgaacctcaaagggaggctctgagaggttaaatcacttgcccaaagacacacagctgtcgaagggcagagccaggactagcacccagcagtctggctccagaggcgatgccctttactttggcacgcgtctctttccattcccttatctgaaacatgggcctgatcatacctattttataaatacgaatggaaggattgagaaaatgcatgtcaaaggcggagctcagggccccgcaccggcatagaccagcagggggagcgctgtgaccagaagtgagggatcctcccaggcataggttttcgctcctaggtttttcatcaggcctcctttggcctcctttctgcagccaggatcacgtttagaaaacacacatctgatcatgtcattaacttaaaaacccttcatggctgggcgcggtggctcacgcctgtaatcccagcactttgggaggccgaggcgcgcggatcacaaggtcaggagatcgagacgatcctggccaacatagtgaaatgctgtctctactaaaaatacaaaaattagctgggcatggtggcgcgtgcctgtaatcccagctactcaggaggccgaggcaggagaattgcttgaaccagggagtcggaagttgcagtgagctgagatcgcgccactgcactccagcctggtgacagagcgagactccgtctcaaaaaaaacaaaaaaacaaaaccttcatcgcagagaatccccatctctgtccctcaggggttcccaccactctatccatgtgccagatctctaccaaggccgggaggtcctccttactctgcagcctcgattctcaggacccacagcctactttgtgatgtggcttcctggcatgctgctctgtccgagtttctgtgcctttgcacctcctccactcatcccacccagcgctatctggtacagcagctctcaaagtgtggtctcagactagcagtatccacatcgcctgatccttagaaatgcacattcattcatgggctccacctgagacctactgaatcagaaactctgggggtggacccagcaatctgtgtcaaatttgagacccactgacttgatagactcttgttcagcctgcaagattcagctcaaatggcctctcctgagggcagccttctctaacacttcctcttgcctaactgcttcctgtgagctccctcctctcccattctaaccgcacagtgctcatcctgctgtgtgaaatggaaccataatcatgaaacaacagccacagtcactgagagcttactgaggactgggaatgtaccttacatgcatttaatccatgcacaaaaaagcaggcaccattcttactaccattttacagatcaggaaactgaggtttacagaggttaaacacctcactcaaagtctcacagctgggaagcagcggaatcagggtttgaatgaatgcagagtctgtttatggtacccctagctctgttgtttttgtgactctctgctcccctagattttggaacccacttatgtaaccccagagcctggtacagtgcctgacacatggacagtgctcaatgcttgactgaaactgttgggcaagtgcaagaagccatttttccctctcatccaccagtgacttctctcctctaagcttcaccagctccaactgtcttccctgctcagagcagagagaaaagaccacttggagtgactctgctgccctcccctcgagctcagcatgaaggcagagatgtgtctccccacctacccctgcatcatcccatcccacatttgcaccatgccccagtttctgagactcacgggcatccaggaaaccacttgggcatctcagattccagtaagcaaagaaaagcgcccaccctagggatagccctaccctgcccatccttccctggctggccctacctggctggtagaagtccggagccagctccctggccaaagtgcgagcaatgttggactcctggttggcagccagggcggcctgttccgctgcctcagctttggccttggcgtggcttgtcctatggagacaatgtggcagaagactcaggatccttccagagaaccagccttctgccccttctccccaacccacaaagagacatgctaaacacagcattctttcacgcaggcagtcaatgaatatttattgagcctcatggcccagactgctatgcattctccagatcatttcttcttctttctgagcacttagatagactacctttcccaacctcccttgcagttaggtgtggtcaggtgactgagttctggccagtgcattatgggaagacatcatgtatgctatttccaggcttggcccataaaaacttctgtgccctctcttttttccccagcattgctggttgaatgcagagcaggctgagtccccagaatagggacttaacttctgtgtcacagatccctttggcagtgtggtgaagcctatggatcccttctcagaataatgtttttgaatgcataataatatacataggattacaaaaggatgcagttacttgacatactgtttccaaaatatttaaaagaacacatttgtaaaataataatctatatctttataatcacattaaacaaaatatcaggtctgttaactactgtaattttaaagtatagataagcataaaggatatttcaaggatatctaattacaacatataatatgacatgaaaatatatgagatttctattggtgacaaagtcacagctgctactactactattatggtttattgcctatttccataattgaagagaaggctacatttcagttggagttaataaaaatacagatgtagcttttctcattgtagtgggtacttctggtgccctatgcagatcccttcactgggcaaatgtgcctacccccggctgatgtgagtgttggctgctaatggctccttactaccccagagaattgtagcccatagaagccaccttgttccagaagttaaaatactgccctgccagccaggcacggtggctcacgcctgtaatcccaacactttgggaggccaaggcaggcggatcacgaggtcaggagatggagaccatcctggctaacatggtgaaaccccatctctactaaaaaatacaaaaaattagccgggcatggtggcgggcgcctgtagtcccaggtactcgggaggctaaggcaggagaatggcatgaacccaggaggcggagcttgcagtgagccgagattgcgccagtgcattccagcctgggcaacagggtgagactccatctcaaaaaaaaaaaaaaaaaaaaaatcctgccctgcctacccctaaacctaggcagcccataccaatgactggtactggtcagcctcctcttgcctcaagaggaaggaactccagctgcagcaggtacaatccatgctccagagcccccggtggactggctgaagcaggtctccagctgagaccacatctcagctcatctccttccctacgccatcctgcctctcattcttctctctcctgaaagcctccctcagtaaatcacttacacaagaatccccacttcaggctctacttctagggaatctaacctacaccgtccaagttcatggacccctgaaatctatccacagaccctcctgtggactccaagttaagaaatgtgagcccataaatgattgcatggagcaaagccccttcccacagccccacagttgcacgtgacaggagcaaattttaaatattcattgtcttaagtacctgagatttgggagatgtctgtttcagctgtcagcttagcttaactcacagaagtacctactaaagtaataacagtccaatttcctaatgggccaggcatggttctaaaggagttatgaagattatctcatatgctcattctaatgccttaggaagctggtgctgttattattatccctattttacagaaaagaaaattgaagtgcaaacaggttaagcaatttgcccaaggtcacagagtcctgaagtgcaggaactgggattttgaacccaggcaacgtaactctagggcagtggtgtccaatcttttggcttccatgggccagaagaagaagaattgtcatggaccacacagaaaatacactaacactaacgatagctgataagcttaaaaaaaacaaatcacaaaaaaaatcccataacattttaatagagtttacgaattcgtgttgggccacattcaaagctgtcctgggctgcatggggcccatgggcaagggttagacaagcttgctctataccagtagctgagcatgtgccagagcctgtgccaggagctgagcatggccaggaactgaggacagagactctgtggaccagaaaggctactgtcagatgagggagctggctagtaaacagacacaaaaactatttaataaaatgcaattaaataaaaagtacctaattataattgtgaaatatgccgtgaaggaggagtagagaatacaatgaaaatgcaggacagaaagacttaatgttgatgggtggtggaggtgggctggtcaggaaaggattccttgaggaagttgacatttgagttgagacttgaagaaacacatacgttaggcccctaagaggtgggcgggtcaatgagccaggtagacagaagggcatgtgcaaagactctgagactgaggaagagctttgtgccttcgaggagctgcaaagccaagtcagagtgtccactctctacagatgagttaattccctggggagctgatgtgtgtgtgtctttatctcagtctacagcagagaactgggcgcacggtaagggggataaattcccttaagcttctactaggcaccagggcttttatcccttacaaacctcaaaactgtgaggtagtgaggtagtgtttaccggtccctacttcacaggtggggaaactgaggttcagaaaggtgtcttgctcaaggaaacaaaataggagttaacatttacaaagcacttagtatatgccaagggctttacagaaattaacttaaccccccaataactctacagggtagatgttattcctatcatccctctctacagaggagacatccaaggcaaaggagtattctaaagaacccaagccagcatggtggctcgtgcttgtaatcccagcactttgggaggctgaggcaggaagatcacttgagctcaggagttcaagaccagcctaagcaacataccaagaccttgtctctactaacaattaaaaaaaaaaaattagccaggtgtggtggcgcacacctgtagtcccagctactcaggaggctgaggtcagcggggggattgcttgagcccaggagatcgaggctgcagtgagctattatcacaccattgcactccagcctgggcaactgagcaagactgcatctcagaaagaaaaaaagaattcacccaagcttacatagctagtaagtaccagagtaaggattcaaaccaaagcattctgggatctagagtctgtatcctaaccacaggctcaatttccattcaataacaagcagcagagtaagattctaaacctggagctgtctgatgtccaagcccctgcctctccactatgccatattgccatagtaatgcttactgaatgaatacatggctgaaggcacgcatgcaggcgtgcacatatgtaggggcaaggagacagcctagggaagagttaagagcacacagttttagaattaacaggcctggattccaatttgggctctgccaaggccagggacagaatgagatgaccgaggcactcgcctcaggggcaaaatttatggggttgccaaaaaactcagtgatcaagaggaatcacattttaatgcaatattttaaaagtctaaattaatgcaaaaataaatccttgatgaacaacctatgaagaaaattttaaataaagcctggattggaccctgcacttggatccctcacttactcactcacctcaccccactgggagtctaggaccttgggtgcatgcatggctttacctctctgtgcctcagtttcttcatctgtaaagtggagatagtaattctcccctcctgaagttgccgtgaaaactaagtgagaggcaacgcgtgaaagtgtttggtcttgatgatgacgatgatggggtgttggtggcggtggtgaaagaggaggaggagaatgacatctgtacatcaaaactgagtgtgctacatgcatatccccaggcttatttttgcctgcacgtgagtatgtgtgagacaaagttctaaactttttagagccacttctctgggcacatgaaaccccaggagggaggaggagggaaagggctgggcaagccttcaaactgagaaaatgccctttttttggtcatgtgagcagaaagatgcccactttctggtgcctttggaagctgggttgaggactcctcaggcaggaaaggcagcctctccccacagccctggaagattctgggggacccactgtgcacagccagaacaggggcggccacacagcccagggcaatgagggctgctgtgctggaagcaagcatactccctgtccatctccaaccacccggcccgctgcatcctatcagcccttctcccctgtcccatgctcccaatctctgatcccagccttcaggccaggaatcccggtgttcttcagcaccctccctccccacctccttccacatccacagcccatcaatcaccaacactggtctctccggctccctttataactcttagaaccctctgccactcctcctgcaccccttcccatgggtctcccctgcctgcaggctcactcctacagctgctcctacacacagcggctcagcgagcttgcttaaccacacacccgtggcctcaccccttgcttcaaatctttgcaaggcttcctactgtgctcaaaataaaaccctagctacttagtatggccttcgaggctctccagacccttgcccaaggcagtctggatggggtataccagcagctcacggggtgaagggcaggcggaatgactgtggctgggaggctattgcttctaggccagtgcctctcctaatgcagtccgtgacccccacccagtatcttcatcacccggaagctcagatatacaaattctcgggctctgcccagaccgactcatcggaatttgaagggaacgagcctaggaatctgtgttttatattccagattctgacttaagtttgagaagcacgtgttcggcggagagaaaagccagctccatcttgaagttgttcccagactgctcaaccccctaggagccttggatgttttccttttagcaccagggtccctccctgaatcaaggccctgctggggaaatgcaggaagcattcctgctctgctgaccactcaccatctctggatccatgcctctgggtgagggtctggaggatggctctgaccctgcttgggggaagggagcagtcactggggccgggggaggaacagggagactcttcttgatttcgttcggattaactttcgtcagcagggttaaaaataaggctggtgtttctgggataggagcagggctctcacccaatagagcaacttctaaaagcacctgcccccaccctggcctcctttccccatctctcctcccaggcccataactgcttggttgtttcccagttgtctccactaggcattggtggctttatggggccaaagggggaccctcaccggacttgccctgactctaggcctttgcttaggctgttccccgacctggaaggctctctcccctcctgccgcgatcctggccttaaagagtcagtttaagacccacctgtatgtattggttcattcatttaatacaactttatggagtgcctactatgtgctaggcacttttctgggcactgaagacatagaggcaaactgaacatccaaaaatcccttgtatggtcaggcacagtggctcacacctgtaatcccagcactttggaaggctgaggcaggaggatcacttgaggccaggagtttgagaccagcctgggcaacacagcaagatcccaactctatcttaaaaaaaaaagtaaaaaagaaagaaaggaaacaaaaatcccttgcagaggttacattccagggcacgggtcagcagatgacagtggtaggctaaacccagcctgctgccagcttttgtaccacccatgaatggtttttatatatttgaatggttagaaaaaaaaaaaagtaaggccaggcatggtggctcacgcatgtaatcccagcactatgggatgctgaggcgggtggatcacttgagactaggagatcaagaccagcctggccaacatgccgaaaccctgtctctaccaaaaaatacaaaaatcagctgggcacggtggtgcgcacctgtagtcccagctacttagaaggctgaggcagagaatcacttgaatctgggaggcagaggttgcagtgagccaagattgcaccactgtactccaactccagcctgggtgacagagtgagactctggctcaaaaaaaaaaaaaaaaaagtaacattttgtgacacatgaaaattatatgaaatccagatatctgtgtccctgtaaacaaaattttgttgaaacacaactatgctcattcatattgtctagagtagttgtcatagagaccatatgacctacaaacaccacaatatttaccatctagtcctttacaaaagtctgccgacccctgtactaatgtattcactcaatgaatgtctcctctactattattatgaataatattaatcttggttatttgttgagcactgtgtgaccagccttacgccatggcctcctgtgtaaacacatatggcctcagagagctggaggcacgttctcaaggtcacacactagaaagtgaacctgcccaagctcttacccatgacaccaagctgctgccttcctggtaccacttctgagccaggtccgtcatgtgctggggccaaggatggaaatgaataggacccagcagccgcctggggagctcgcagcccaatgcagccctgccaggtcaatcaggcaacatttctggaagtccatggatgagcaggggctcagagcaaagtctataaaccacatggtggagtggcaaagaggcggtaactctggccagattgcccgggtgcagaccctggctctgctcctcatcaccttaagcccagtctcctcatctgtaaaatgggaataataagggcacgcgtctccaaggaatgatgtgaggagtaaattagttacagtcacgtggctcagaacacaggaagtgctacctaagggcttgttacataaaatgagaagtgcagttttagcctgggcaacacagtgagaccccgtctctacaaaaaataaaaataaaaacattagccaggcatggtggctaatggaccccgctacttggaaggctgaggtgggaggattgcttgagcccaggaggtcaaggctgcagtgagctatgattatgccactgcacttcagcctgagtgacaaagcaagaccctatatcagaagaaaaagagagagggagggagggagggagggagggagggaggaaggaaggaaggaaggaagggaggaaggaaggaagaagggggggagggggcacagtgttttgaaggggactgaaacagaaatcctgaatgtcctaaatgccactgaattgttcactttagtataataataattttaaaaatccttcagcccaggaatcccatggtaggtttggatgatgggggcagataatcagggtccctggctcaggccactgccagcctctctggaggatgctcaggtgattacagggaaaatgctgcccagcgtcttcctgaggtggggatgcttccgatgtcactgccctaccctctcccaaaatagcccctcatccccagctctggctggtcatgaccatctaccccagaacaaccatggtcaggctaatctagaggaaggaccacagctgggtgtccagtcactggcccagagaactccctaggagaaagccccctccgcccccaaggatgcaggtgcagtcagggagccctgacccatgggaccttcctctccccacccaggactccattcattctcattcggcaaatgtgtgctgagcccctgctatgtggagcccagaactgggtgctagagacatggacagtggtcaatgaggcaggcagtgccctcctgggaagcccctcacaagacaggttaagggcacaaactcaagcccaatttgtagcaccatcatctagatatctgacctttgctctctggcctcagtttcttcaactctgaaatgggggataatctcacaaaattactgggagtctgaaatgagatagcacaaatgtgcttagcatgaactgagcacgtaacaaatattagctatcattattgtttctgttactattataacaatgctgaccagcattcacttccaaaattctatcatttgccaacatatggatgtgtcatctaaacatcatttcagggttcacccacattgtagcatgcatcagtacttcattcctttttattgctaactaatattccattgtgtggataaaccatattttgtttacctgttcaatagttgatggacattagggtgctttccactttttggttactatgaataatgctgctatggacatctgtgtacaggtttttgggtggacatgtttttattcctcttgagtatatacctaggagcagaattgctgggtcctgtggtaactctatgtttaactttttgaggatctgccaaactggtcttgagatggctgtaccatattatcatattatgttccattggtaatacacgagagttccagtttctccacatcctccctaatacttgatatcatccttctttttttttttttttggaaacggagtctcgctctgtcgcccaggctggagtgcagtggcgcaatctcagctcactgcaacctctgcctcccgggtacaagtgattctcctgcctcagcctcccgagtacctgggattacaggcacccgacaccatgcctggctgatttttttttgtattttttagtagagacggggtttcatcatgttagccaggatggtctcatctcctgacctcgtgatccacccgcctcagcctcccaaagtgctgggattacaggcgtgagccaccgcgcccggcccatccttcgttttgattgttgccatactagaggtttgggaagtgccatgtcattgtggttttgatttgcatttccctgatggctaatggatgttgagcatctatgtgcttcacggctgcttgtatatcttcttaggataaatgtctatccagatccgttgccagattttaattggatttttttccttcttattattgagttgtaaaatttctttatatattcttatgcaagtcacttatcatatatatgatttacaaatagttttcccattctctgggctgtcttttcactttcttcctttgaagtacaaaagttattttattttaatggagtccaatttagctatcttttgtcacttgtgcttttgtcatagctaagaaggttttgcctaatccaaggtcaaaaaaatttactcatattttcatctaagaattttatggttttagttcttctacttacttctacaaacactgtttctaataagaaaaaatgggaaataacctaagggctcatcccaccctctgaggtaggtactaccaccactttacagatgaggaaactgaggcacagggaggttagatcatttgctcattctcgttataatcaaagtaataatgaaggcagacatggcccctgctcttgaaggttgtagagtctgctaagagagacaagaccaagtaaaaagtcttgagtgcagaacaagcctatggggcaggagaaagcccatggggtgggtgacatgttcataatttgtattttattatttttatattataaatattaatataagacatattgtatgcactataaaaataaaatggcttcctcaaagaaaattttggaaaatgagcatttttaaaaataaaaaattgctattaatattttcgtctttttctttttaacattttttttttaaagatacagagtctcgctctgttgcccaggcttgggtgcagtggtgcaatcatagctcactgcaaccttgaactcctgggctcaagttatcctcccacttcagcctcccaaataactcagattacaggggcatgtcacagtacccggttaacatggtagtgtattccaagttggttaggaacacagctgcatgactgttggtgacttactgaaattctctgtgctttgatttttccatctgtaaaacgaggttatgaagagcccctatctcataagcttgtggggattagagagagaactgaccagcagaaagcactgggaacagggcctggcacacagcaagctcgatgcagatttgttctagttgaggtgaggagtaagggtggtgttggggattctgaggttgggggctgtgatagccctcaggccctatgtagaacctctccatcttggaagctccactgaaatcccccagcctccagctggagtgaagcctcctctagtgagggagtgggtgtgtgagctctcagcctagaagaccgggcaaagtaataagtgttgctgcttagcggccgggcgcggcggctcacacctataatcccagcactttgggaggcagaggcaggtggatcacttgaggtcaggagttcaagaccagcctggccaacatggtgaaacttcgtctctactaaaaatacaaaaatttgctgggcgcagtggtgcgcatctgtaatcctagctactagagaggctgagacaggagaattgcttgaatccaggaggcaaaggttgcagtgagccgagattgcgccactgcactctggcctgggcaacagagccaggctgtctcaaaaaaaaaaaaaaaaacaaaaaaaacaaaaccattgctgcttcctgagagctaactatgcgccagacactcagccaaaggcatcaatgaataatggccccaaagatatttggtcctagtgtctggaacccgtggatgttaccttctatggcaaagagggctttgcaggtgtgattaaataaaggatcttgagatagatcatcctggattagacaggaaggccctaaatgtaaccacaggtgtccttataagagggagatttgataacagaagaggagaagccaatgtgatgatgggagcagagatgggagtgatgtgttttgaagacagaggaaggtgccataagctcaggaatgcagagggccagcaggggttgaaaagacaagcacaaagatcctcccctttgagcctccagaaggaaatctgactttagacttccgacctccagaactgtaaaagaatatatctgtattgttttaagccaccgagtttgtagtaatttgttactgcagcaacaaaacaaaacaaaacaaaacaacctgtgtgatctcatgtcatcctcaagatgatgcactttacagcggaagaaacgcaggctcagaaaatcatttgcccatggctcatagctagtaagtccagagttggcttgagcccaaacccaggactccctggcacaaaagcctttgctgacccctgcatctgctgcaccgcttcagctcctgcccactttctacagggcccagcagctgtggttgcctcagcccagtcttgtcccccagggatatcaagaggcccccgagttttatattcctgatattcctgctgcctgtctgagagggcctggggctgggttaccagcatgttccccacatccttcacatctgcaagaaagtctggttctctggggcctggcatcacctggctgactgtgcaggacggagatctggctgcactttggcaaccaatgaaatgacagggagggaacctcgggccttgctcctcctccaccaaccaacagagtagtggaccctgcagttcaacctggatctagctgctggcaaagaggctttcactgcatgagctgacagagcactccaaaaccacacggggaaacttccttttcaaaaaatctatgcctgattttaaaattttacaaactataaaaaccattacattaaagcaacagtgcgctgacgtcactttgctaatgcaatagctattttagcttttgagccttccttgtctgtccaggtgcacacctattattttttcgttttttggggggcctccatttataacacagtgtacacacctattttttatcagggctgtgaacacaataaagattccatttttgaggcatggtggttaatagcatggaatctgaagtcatgctatgtgggtgtgaatccctgacttactagctttcacctagacaagtcaattagtccctctgtgcattggttttctcttcttcaaagtaagagatgtcaggcagatttctcatatggctcctgtattcccatcctagcgtaatcccttccccctgagtgtgggctggacctagagacatgcatctaaagaacagaatatgcaaaagtcatgggatgtcacttccatgattcgtttagactgtgacttctctcttgccaccagagtctcttgctggctttgctgaagcaagctgccatgttggagaggaattgagcccctcagtctaataggctgcaagaaactggatcctaccaataccacgtgtttgagaaatggatatttccctggtggagctttcagatgagaccacagccctggccaatacctggactgcagcccaagagagaccctgagccagaggactcagctataccctgatacccgacctgcagaactgttaagacaacaaacgtgtgttgttttaagctgctctatgtggggacaatttgttatgcggtgatgggtaactaacacaatggggataataatagtgcctacatcatagggtaatgaaaattaaatgagttaatggccacaaaggtctaagaacagtgccttgcacagagtaagcactatcgaagggttagctgttcctgccatacttttataatttattcacttaagtaattttccagtttccatatactgacatttatcatttaattgttcaaccatttttttctttaaaaatccatcatctacatatttttgtgctagtgattccccttctgggagtgtgatcaacagatatactcaaattgtacaaaatgacacatgtacaagtcccaaatgacttctggaaacttttgtccccagacccatcattcacttctttatctggtgaactcctactcatccttcaggaccctaccccaggaaagcttaccctaactgccagctgtctgctcttaccatctcttgcacttagctgccaggtgactttgcctttctctgattagcctgtgagctacacggtatttactgtaacactgtaatagcaaaagattggaaacaaagccaagtccagcagtacagagctggttaactaaattatggcatagccatttgaaggagtattatgtagccaatcctaggaataagattgatctttgtgtatgacaaagagtgaattccaagatatgttaaatcaggtagcaaggtgtaaaagaatttctattgtatgtaacatttgtgtaaacagacaacctgtttgctcttctatatagagaatatttatggaaagataggtaagaaacttataatacaggttgcccactgtgaatgaggtggaagggaggcagacagacagacacacacacacacacacacacacacacacacacacacacacacacatttgggctggttattttcctttggccccatctcccccccttgccccaccccatccattccctacccagctctgcccagggagatcatctctacagcctgcatcactagctcccttgctcactggcttccagtgcgcccagtcaattcagggcccaagcacgaggccggagagggctgggtatctattccacttctccctcttcctgcctgtctgtctcctccacagctgcagctctcacccacccccaccgtccccctccacacctgcagctctcacccacccccaccgtccccctccacacctgcagctctcacccacccccaccgtccccctccacacctgcagctctcacccacccccaccgtccccctccacacctgcagctctcacccacccccaccgcccccctctacatctgcagctctcccacccccaccgccccccacacctgcagctctcatccacccccaccacccccctccacacctgcagctctcacccactcccaccgcccccttccacgcctgcaggtctcacccacccccaccgggcccctccacagctatagctctcacccacccccaccatccccctccacagctgcagctctcacccactcccaccacccccctccacagctgcaactctcacccacccccaccgtccccatccctgctccagtcatcacaccatttccctgtcccccacctcttgccccttcaggcctggggtataacagctcccatggctgctggtcctggatgccttaacataccttgttaatttttctgcccacatctctgcaaacagcaccttctttaaactctccccaattaaacccttgcaatagaccctttcctgccaggacccacactaatacgatccttctggatattctgaatgtgcataaattataatcactccaaaataaatatttttaaaatctcacatctattggtactagaccttttagaagtatggtttcatttattccttacaacaatcctagcaggcaggtattattatgtccactgaatagggaaactaggcctcctttgggggcagccacacagcagggaagctctgggttgtgatggaacggcagtctacctgattccaaaggttgtgctaagccgcatcaccagcacctttgctcactggcttccagtgtgcccagccgactgactggaggccccagcaagaggccagagagggctgggtgtctattccccttctatgtcagggcaggatggccctaggggagattcaagtctaatctcctgcctatcaagcaagaagagggaaaggcctgggttaaaaacctaagtttcccaggctggtcctgttccatctgatgctctccaatgccttcttagagctggaaggcatgactgagatgtaggcagggggcgatataaataaatatatacttattataaatatatataaataaatatacattataatatataaatatatatttattataaatatatataaataaatatacattataatatataaatatatatttattataaatatatataaataaatatatattataatatataaatatatattattataaatatatataaatatatatattataaatatatataaatatatatttatatataaatatatatttattataaatatataaatatatatttattataaatatatatttattataaatatataaataaatatttattataaatatataaataaatatttattataaatatataaatatttattataaatatataaatatttattataaatatataaatatatatttattataaatatatataaatatttattataaatacatataaataaatatttattatatatacatataaatatttattataaatataataaatatttattataaatatataataaatatataataaatatttattataaatatatatatttattataaatatatataaataaatatatatttattataaatatatataaataaatatatatttattataaatatatataaatatatatttattataaatatatataaatatatatttataatatatatttattatatataaataatatatatttataataaatatatataaataaatatatatttataatatatataaataaatatatatttattataaatatatataaatatatatttattataaatataataaatatatatttattataaatatataaatatttattataaatatatataaatatatatttataaatattataaatatatatacattaatatatattataaatatatatttattataaatatataaagatatatttattataaatatataaaaatatttataaatatacataaatatacatttattataaatatatataaatatttataaatatacataaatatatgtttattataaatatatatataaatatatatatttatatatatattaatatatatttatatatatatataaaatatatatatttatatatatatataaaaccacctgtgccaggtggctaaccatttagctgctgggtgctgggaatgaccaagtggacagaataccaagaggggtaggggggatgcctggggggctcagggaggctgctagtgacaaaccagtatagactatttcaatatttaacaattggcatgaccatacctactggggtgcccagctagatgctaaccccggatgtaaacgttccttcttatgccccatctagtccagaaaccttccccagaggccacccccagaaaatttggtcttaaacctctgcttaaaaccccacagtgcctttcctagtgcctgaaggatgacatggaaatgctttcatgtaacttcatgacttagctcctgccaacctctctggtctgactccaaactcaaccttctagtcagacagaaacttccagttcctcaaatgtgccctgtcgattgtttctatgcctggggtgaaaacataggtaatttcttctcctgggaactcttgtctccatccccatctttcggttctttatctggtgaactcctactcatccttcaggacccttccccagggtagctcaccctgactgccagctctctaccgtctcctgcatttcgcttccaaggtcactttgtcttcctctgattagtctgtgagtcccacaaggggcagaagcttcgctgctgcgtgcctgtcaccagacagaggctggcacagagcaggactatttatctgaaaatatttaggctcaccaggaatgtgctggacaaacgttttgttatatgaatcacatatacttgactgtgagactcacagagctggacggacccttagaaatcatctcatctcctttaagatcaacacagcaacaagaaggggaaactgtggcccagagaagtctgtgtgatcattttcaattttcaatcattgagagttagtcattgtgatcgttactctgttatagacatattggaagggttaggtactacatgacaggcccattgtaagtgcttgtacatatcatgtcactttactgaacagcagccttatgagagaaatactatcattatcaccctcagtgtacacatgagaaaaccagtactctgagcatttcaataacttgcccaagacaacctgtacacagacagcaagggatggcaagttagtccaggtccacaggaggtgcttcatggaagccttgggcaatggagctgacacaaaaatgtgatcatgtaccatggatgaacagagggtaaaacctaccccagaccccttccagcctcatgcttggggaacctggaggcctcagatggcctaggagtagtgaacatttctctttaggaaacacagacaggatgaaggtcctgccaccctctccagagggccatgactgtcaccgtgctcctgcagggggacgaagtctgctggaaaatggcctcaccctttgcctattctgctccctgggtgcaacccagcaagaggatgctgaatcccctgggactcatcgccatcatcatcatcaacatcaacatcaccattatgaataggcaatgcttgctgcgcacctactagatgcccggcacttgcatgcgttttcttaattaattctcacaatattctctaaagtaggtatcactatccccactttgcaggtgagaagattatataacccgtcaaatccacacagccagggaagaggaaagccaggaatcctattgtggcttaacaccaaaataagaagatggaagcattagttactactggagtcagacaacctggtttcaaaccccagctccctcacttccaacttgcatgatctttgccaagtcatggaacctctcccagtctcagtttccccatctgtaaaatgggttactaatagcacttagctatactagtagctacttcttgtaaggattatgtaaattgtggcatgtgaagggtatattcattcagttgtgacaaggatttactaggcacctaatagaccctttcctgccagaacccagactgatgcaacccttctggatattctgaatgtgcatatagtatatagtatatgtgtacattatgtgtaccagaacctgggctaatcttggggtaccattgtgaacaggagagactcgccttctggaacttacagaccagctcagcattgtgcccagcacatagtaggtaccccatgaatgttagctgctattttttgttatcactacttagcggattttctccccaagggttgggctcccaccctggggctcgcctgcccaggagcctgctgacttagctcttggtgtgctctgcccccgccccgccccaccccacccgggagccggcctgcaaaggcatcttacaaggccccagtcagcagacatctcctgcctaaataaggacaaggcgcccaggagagctttctgtgagccggaggaatgtgacagctgagtcctcccagcccagcggcctcccccgcctcccgcccctccccaggtggggctcggctggggcattccagcttttcccagagcagatcccagtgtcactgacacccactcgcaccccaccccaggctgctctaaaaactgataaggagctctgggaaggaattccaggcagctccatttgctcctgggggctggcgaccctgctgtcacaaggacaggggaggaagaagccaccaggcggggccgaacccagccttcctctggacaactgcatccctttgttcaaaacacacttccagagatcggattcggccccaggcaccgtgccaggtactggaggtccagaggaggttccaaccccgttgccttatcccatcatagcagtcacaactgggctaagtctttgaatcctgccctttcaaagactggattttgaacaagtccttctaaatactggctttccttctctctgacactgggaagagggagaggagaaatctgtctttcaggccagtgtctctgaaggatgggatgctttctactggcaggaccaagaatgataggtggtaccagaccattcattaagtaacactgtagaaagtgcatctgtaaaaagagaaaaaatttaaaaagaccttttttttttttttttgagacggagtcttgccctatcacccaggctggagtgcagtggtgcgatctcggctcattacaacctctgcctcccgggctcaagcaattcttctgcctcagcctcctgagtagcggggattacaggtgcccgccaccacgcccggccaatttttgtatttttagtagagacggggtttcaccatgttggccaggctggtctcgaactcctgacctcgtgatctgcccaccttggcttcccaaagtgcctcccaaagtgtaatcccaaagtgctgggattacaggcgtgagctttaatgcgtctcttacacgctgttttttaactgagagcccagcagcaagcagccttgagtctgagtttgtttgctttattagacagagtctggctctttcgcccaggctggagtgcagtagtgtgatcatggctccctgaagcctcaacttcctgggctcaagctatcttcctgcctcagtctcccgaacagcacctgggactacaggtgagcactgccacacccagctaatttttttatttttttgtagagatgggttctcaccatattgcccaggctggtctcaaactcctggcctcaagcaattctcctgccttggccccctcaaagtgctgggattacaggcatgagccactgcacctggccaagattttaataagcaactgagggatggggtttaatgatattttgcttcactgtattctttttcttcttctttttcttttttttggctaactttttctaatctaatactagatttgtatttatggtaatgatctaaagtttctttataagaataaatttagatttaagaaagttaaaatgttttttaaatagtaaggggatccagacagcatgtggacacggcgcggctcaggaaggtatggcagtgactggcatttggcaatcgctgccttgccccagctgccacaccgctgtgcctttgcctcgcctcgtcctcctgtttgctcttccatgctgacctcactgggctgccctggactccctctgagctaaagtcatctcccaaaggatccacagtaacaatagctgcccatgactgggacgtgggaaaggccaagcaaggaagtgaatctgggccggcttttttccccccaaggacaaggcaaggagagctcagtgctccaggaaatggagaaccacagaggggcagggacttgcccggggtcattcagcaagtcagtggcagaggccttcccaccctaaaacaatgtggacgggaagataaaatgggacagccaccacagagagcctttgatccagcaactgcgagttgggggaatttattctagagatataccaacccatgggtggaaatattgatctaacacagcaaatatctggaaactacccaaacatccatgtacaacaatggggacctgattcagtaaattgtggcacagctatataatggaattctacacaagcatttagaaactgatcaagttctgtacttggaaaaacatgaatagatctccaatatatacacagcaaagaaaaaaaagcaagattccaaacagtatgtatatgctacagtataatatgctactttttgtgtaagaaagagaagaacaggaatctatacatttgtttatattaggttgaacagtatgaaattgccattttataggccaaacctggtcaaatattagcaatttcatattttccatcttaatagaaagtaactggaaggaaaggaaagaaactacaaacaagagttgcctatggaggtggcaacaagatggggacaggaaaaggagatggactctttatagtaatacttttctaactgttgggttttgaaccaaatgaatgtatgattttttttttaatacagagtctcactctgtcacccaggctggagtgcagtggtgcaatcttggctcactgcaacctctgcctcctgggttcaagtgattctcctgcctcagcctcccgagtagctgggactacaggcgcgtgccaccttgcccagctaattttctgtatttttagtagagatggggtttcaccgtgttaggcaggctggtctcaatctcctgacctcgtgatctgcccgcctcggcctcccaaagtgctaggattacaggcatgagccactgcgcctggccgagattttatttttttttaataaaggaaaacaccagtagggcctcttagggcaggctttctgcaacatgacacctgtctttatatccatcccagctgggtggtcagggagaaactgtgcaggcctgagcccagggggcaccccagtttagcttctgacaaatcccttctagagaacctgctctgtggcatttcccaccctccacgtggtgggtcagagctccaggggcctccaccccttgggccaggcttctggcaaagctacagcaggtcctatgggatgatggttttggcaccaggctgccatgactttgtaggagcacccccttgccagacagggccacacgaagccagggctgatgggaaaagcacttcagcagcaatgcaataggtccccacaaggatacggcttggccaaaggtagctctgaaaacgcattcccaccgctgcccctccctcctatctggtcctatggcacatgtcctctagcagcctaaggaaagaggttctccctggggtgatcgctgggattatggaaacacctgggagatccccaccgagatctcacccttcaataacaccaagaagaatcactgaagcaagggtaatcgtagaataatttttttaagctgccactattgaatgactgtggtgtacagtatttacacaggttatatctcattttaccctcagtggtaagtactatatcaatttctaccacctcccaccgttggagaaactgaggctcaggaaagtgacatgcccaaggaacgagtgttatctaaccccaaagcctgtgctcttgaccgtgaatgatgtttgtgcctctgtctctccatctgaaagatggagaaggaggagacatgaaaacagaggtgcagtgaaggggctagagatgtggtgaccagggaagactcgggatattaaggtcacagtcttcaaacctctgcaaggatgttgagacagacattgctagctgctcaccaaatatccattctctccctctttcccactaacggaagcctaatttgttcagggaagcaacgcatccggctaaaaatattcaccttcccattctctacatctggggaaggtcttcacttctgcatggagagaagctgttgcatttggacctccgctgcctggaatgcagaggtgaggctaggtgtgcagtggctatttctgagtgtgaggacaaaagccaccctctaaggacagagggagggaaaggcagatggaggcgggtccctgagggcatcatggagctgccattcagcctagcacagcctctctgatcacatcatgtgagaaaaagaagcccaatgggtgaggcagtagaagcagttttttttttttaagagaaagggtcttgctctgttgcccaggctagagtgcagtggtgtgatcatagctcactgaagccttgaactcctgggctcaagggatcctcctgtgtagctgggactacaggtgcatgctaccacgcctagctaatatttttatttttttatttttatttttgtagagacagggtctcactgtgttgcccaggctggtctcgaactcctggcctcaagcaatcctcctgcctctgcctcccaaagagctgggattacaggcaggagccaccatgcccagccacaggcagcttctattacctgcagctgagcacagttctaactacacaatcctcaaggatagcaccaggacccatgggtagaaactacagagaagcagaaagtccttctggttttagcaaatccaaaaggcaaatctatcaaaagctgggctggaccatctcaagagatggcgagctccccatgcctggagagacagacgcagtgactgaatgaccacttggcaggacgatgggaaaggcattctgacattggctggggttggaccaaatggccttgcatgctttaatcatacccactttgggaggtgaggaaaggcccccaggatgtgtgcccagttatgtatgggcaagcgcatatgccctaccctgacctgcaaggcccccgaagccaccacccaatagaactttcagggatgaggaaaatgttctatatctgtgctgtcccagctatcgaacacttgatatgtggctgctgagactgagaaaggaaacttttcctttctttaacttcagttaacttaaatggccacaggttgctagtggctcccagattgtacaacattgccatccatccccgccgcctccccacgctctctccggccttttctcgcactgctgtcctccccctcactccacttcagccccactgggctcctcactgtccccagagcacgccaagcacatgcccacctcagagccttccctggcccctccctctcccgggcagctccccctgacgcagccccctggccagctctttcagctccgtgtctctgcttcaatttcaacgaggccttcctcagtgaggccagccctgaccacatattttgaaaggcaacttgcccgaccacaggctctgtctttatgtacatctgttgtgctgtctgtctccccagcgggagggcaaacatcatgaaggctggatcttcaggttttcttccccaagagcctaaaactttacctggcacagagcaggctctcaataagtccttgttgtatgtatttcaaggctgaaatgaataacatggagggtgccccatgctgtgggttcttcccattacagtgtgtttaaggcctgatattagtcagtcaaccaggcttcctgggtcacacatacctgctgggtgctaggccaggtgctggcacctgggactggggagccgggggcacataaaacaggaaacccagactagaagggagctcagagctcctctgaggaagaaacagtcaagctgagtgaagccagatgaaaagagcaggtgttcgtgagagagtaaaggaaaagcattttggacaaatggaacagcatgtgcaaaggactgcaggcaggaaagagaacggccctttgaaggaaacatggctgaaggcaaatgatggggagagtggtatgagatgaggccggtggggtaaatggaaccagacaggaagggacttgggggccaaaggaaggaatctggaatttctcctgaaagcaacacccccggtgcctgcctcccagctcctgtgtctacccctagtttcccccgtagctgtggaggcaagctccatgtaaggtcagactcacccagcactgtcagggtcccacgcaagcacagctgtccaattcctgcccagagcctgctctgaggctgcaggaggccccttcaccctctgccgcttgggaaactcccagtgaatgcggcactggagcccgcatccatccttcagacggacaatgctgcagatactgaggtctgagctggatccagtccccgtggtctgcagtgatgcctcaataacacacacctgcaatgcctgtccttcttccttctcgtgctccccgctcacgccctctcagctcctccctcctggcatcacctaccagtaaactatctgcacctgaatccttgtctcaggctctgcttttgcaggaaccttaactgagggccccatgagagttttgtatggcagcatggcacatgcaggctgacattttttaaagctcatgctggctattgtgtggagaagagtatgtggcaggaggaggcatgaaaagcagtgagggacccttgcagaggggcagtgagaggagctggtggccggcactgggctggtggtagtgaagagagagagacaaataggggatggagacaaagagggggtgcttgactccccaaagaaccagaggctcgagaggcaaggaggggtggcatggaggcaaggcttgggtcacgcctggcttcgggaaccagcctcgccaagttccatccctcaagccctgcctggctgtgaagacctgttgcaaaggggttatttttagagagttgggtgtttacttgaaggatttaaagacgggctttatttttaactccactcccaatggcagggactcactggtatggacttaggaagtcaagtggaagttggactgggctttggaaacccagaggagagaagcggcatttggggaaggatgaagcttaaaggagacagctggcctcaccacgttctactcatctcgggctccgggtaagaacgatgatgaaactgcccacggtccctccttaccaagcacccaccaaatgccacggccacatgaagccctctacaaacatcgcctcgtattgtcctcaccataaccttggggggacagggctgttactgtccccattctacagacgaggaaagggaggcttagggaagaccaaggacacttggtgggcaagtaacagagcaggatctgagcctcgattcctcagcttccccagcctgcactctcagtcgctctaccattcgaaagcatggccaggcaccgaggtctaggcacggagtgtcagcctgggagcagctgagagactttccctccccaccgtggtgaagatggtggagtctggctcagagaatcggaagcccagctgtgtcagttctcgtgtgagtttggactggttttctcatctgtgaaaagggctaatataataagtagcacctccttcgtgaggtttacatgaaatgagacatagaagggaactcagtgtagaggctggcaggcagtggtgagaagggggcactcagagatgccctgtccatgccaggcactgctcccagcactgcacatttatcaacaccaacatgaccctctcctaggccccacggggcaggttctctcatgatccccaccttagagatgaagaaatggaggtacaggaagcttagggaaaagccgcttgcccaaagccacgaggccagtgagagtgcaggactagagcccaggccctgaccctggcctgaactcactgaccctggggcagccactagcattctcatttttaccgttatatcaacactcttggtctgggcccttccagcactgatccgaatccctggggctcagctcagagccaggagcagggccaggcactggtctcactgtggggaaacacttgcatctgtgggagagggagatttttctcccgaaggtgcaggctgctggcctgtatgttctctgactctgctacttgggctgaaaagtaaagctggaccaggcgcggtggcccatggctgtaatcccaacactttgggaggccgaggtgggcggatcacctgaggtcaagagtccaagaccagcctggccaacatagtgaaacccccgtctctacgaaaaatacaaaagttagctgggtgtggtagcgtgcctgtaatcccagctactcgggaggctgcagcaggagaatcgcttgaacgcgggaggaggaggctgcaataagtcgagattccaccactgcactctagcctgagcgacagagtgaaactcgatctcaaaaaaaaaaaaaaaagtaaagctggcaacactctggagctaggccctaagcaccgtttatagaggtggaggagataaaaacattcctttccactttgtggagttctgtcctctttcatttgatttattaattgtgacccagaagccaactgaggcttcacgagagcctccctcaccctgccttccagccacactcctctctgctctgaccccgactccctgcacaaccctagctgggtctctgccctttggtaggcctcagttttttcatctgtaaaatgagcacgttgggcctcctctttcctaaggcaccttccagctctgaccagctttttctgaagactgaaggaagcacgctgggtcttttctctagtactctacactccaaggttggaaggcctggctccccaaaatgcatggtcaccattgttcttttttttttttttttgagatggagtctcactcggttgcccaggctacagtgcagtggtgccatctcggctcactgcaagctccgcctcccgggttcacgccattctcctgcctcagcctccccagcagctgggactacaggcgcccactgccacgcccagctgattttttgtatttttagtagagacagggtttcaccgtgttagccaggatggtctcgatctcctgaccttgtgatctgccctcctcagcctcccagagtactgggattccaggcatgagccactgcccctggcccacatggtcaccattgttctaacatctccttgctgcctgggacccaggcaagctcccctctctgcccagaccactcagccttccagtcacagctgcctcatgtatgtctcgagaatccggctctgacaactcaggaaattccattcactcctgcacctcagtttctgggcacaaagggactttgtccatctggtaattcacaaaggagggatgtggtgaagggcaggagtccggggtcgggggcctttccaatgcttcaagcccatcctcagggaattcagtctctcttagtggaacttcctacctatccaggcatctcaggaggtaagccagagacactgagaaaaaggacagacatagcctctgtggatatgggcagttgtttggaggagtgttgaaggtggccactgggttcacggaacaccagattttcttcaaaattttttgagtttggcaaagatgcaaaagactgatagcacatagctccagcagcaagggtgtgaggaagactgcgctcatgtacactgttgtgggggttataaattgcaacccttttggatgttaacttgggttctgataataattaaaatgcacattctttttgaccccaaaattctaattttaggaatttagcccataaagtgtcatctgcatctcctttgcaattattattctttaaatatttgttgaacatatactggagaggtggggtgagacactagatggggttggctggatttctgctgaattcactcaggggtactgtggaccctgtcaagaggaaccaaattgaccaaattgacattttgacagtaaatgtcaggagtcagtcccttgcaaaggcccacgtgaattgccattatattcccaatgtattccagtgctgcttgaatgtccctgatgggatacattgcctggctgggccattcctttaatcagccctgtgagcaaggatattggtccaaggctgttcactgcggcctcactggtgatcaagaaaacatgaaatgttttcagtctccatcaaaagagatctggttcaatgaatcatggtacctccacactacggactagcatacagctgctaaagggaggaagataaatctacatgcataacataaaaagatctcaaaacatattacatcaaaaacgcaagttccagaacattatgtaggtagtcctagttatgaaaaacaaaaacgaacaaaaccagaataggtaagtagaagaattctataagcaaattgtaaacaacggtcacttcagaggtgcaacccgggtggaagtagaacaggggatttattacttttttattttgtacgtgtatgaccttccttggattttgcgtgtgtaagatcttccttggattttaacgacagatatgttgtttagaacaatgtaagaaaagaagaaaggaaagagaaagaaactcaccgtatctgaagtagcagcacagggtggtggctcagaacatacgactcgggtccagaatctcagctctgtcacttactggctgtatgacttaggacatgttaaaaacaacacaagggccgggcatggtggctcatgcctgtaattccagcactttgggaggccgaggcgggtggatcatttgaggtcaggaattcaagatcagcctggccaacatggtgaaaccttgtttctactaaaaatacaaaaattagccagcggtagtggcacgcacctgtaatcccagcgactcgggaggctgaggtaggagaattgcttgggcccgggaggcagaggttgcggtgagccaagatcacaccactgcactccagccttggtgacagagtgagaccttctctcaaataacagcaacaacaacaacaaaaacaaacaaaaaaacctctctatatgcctaagttagaattagatgagttaatttagctgagcacttagtggccgccacatattaagtcctcaatgaatgtcatccaatagcgttggccattattatcccagatctcctgggattccccgagacagctgaggctgagtggtgggactggaaatggatgctgaggctgggtcagcccccatgtctcctgactcccgttccagtgctccttctgctctacgtgcctgcctctgtttctgacacaatggccttcccctaacagatgaggaaagggagtgtggtgaggaaacaaggaaaggaaacaaagggttcttcgtttctttcccacctgctgacaacgtcctggatgcagaaaggggaaatgtgttgggcgaaggcgacccgagctgccgcgtggccttaggttcgttactgcccttctctgtgtgtgggttctgggtatttcccctcccttctcccccacaatctaaggtgggcatctctgaacacctgcaagccccctgattcaacaccgggcagactgccacctcaacactctccttcctccaattaaaaaaatcaacaatcggccgggcgtggtggctcacgcctgtaatcccagcactttgggaggccgaggtgggtagatcatgaggtcaggagatcgagaccatcctggctaacatggtgaaaccccgtctctactaaaaaaatacaaaaacaattagctgggtgtggtggtgagcgcccatagtcccagctactcgggaggctgaggcaggagaatggcgtgaacctggtaggcggagcttgcagtgagctgagatggcgccactgcactccagcctggcaacagagcaagactccgtctcaaaaaaaaaaaacattctccctcctccaattaaaaaaaaaaaagaacacaagaaggacaatttgactaaccatgccccaggcttctggaagcccaagcccagcctcctgatggtgccaccaggccctcccttcccaccccagtggctctgccatgtttcatgtctccaccatctccccagatccctgcattagcctcctcactgacgcccagcctacagcctagcccttgccatactctcgctacaagagccatggtccaggtgtggtcatacacatttgggcagaccgctcccagctctcgtggctacccactcacaaagcggggcagggtagcatatagcacacatatatgatttctccgcctgcataatatttgtcgtgtgtgtgtatgtgtgcatgtgcatgtgtgtagccacacgttggtgagttttcctgcctggatgtgagagctttggggtttagtgacaggtgtgctaggcctccctccccatttccctgctgctccatcccactgcctgtgaccctgccctcttcttccccacctccttctgccctcttccccccaacccctgctcctaaatcaagtcctccaatttgttatacagagtacttaagaactggaagattttgtgcagggcacagtggctcatgcctgtaatcccagcactttgggaggccgaagcagtgggtcactcgaggtcaggagtttgagaccagtctggccaacatggcgaaaccccatctctactaaaaatacaaaaattagctaggagtggcggcgcatgcctgtaattccaactactggggaggctgaggcatgagaattgtttgaacctgggaggcagaggttgcagtgagccgagatcatccactgcactccagcctgggcgacagaggaaaaaaaaaaaaaaaaaaaaaaaaagaattggaagagttcatgctaaccggacattacatgccccctgatgtgatacaatatgaagtacacagaactatttattaagttttcatgccagaaaaatctaatctgaatccatttgagacagaatttacaggaagtacaggaaagagagaaacaagttaaacagcaccataaggaatcagcctgacaaatccagaagatgtcatgtcataaaaaaaatgaggaggatggttctagactaagagatttaggacacagctcccaacctgaaaataaaatttaaaaacaattctacttaaagtagcagcaaaaagaataaaacatttagaaataaatttggcaaaataagtataaaattgtacactgaaagctataaagcatcactgaaaaaagttaaagacttaaataaattgaaaggtgctccatgttcatggattggaagacttaaaattgttaaaaggacaatattcccccagttgacctacaggtttaacaaaatcccagcggcctttttttcccctgcagaaattgacaagctgaggctaaaatccatatggaaatgcaaggaactcaaaatatccaagataatcttgaaaaagaagaacaaaattagaggactcacatttcccaacttcaaaacttagtacaaagctacagtaatcaagaccagcctctggcataaggatggatgtatatagatcattggaacagaattgagagtctagtcaataaataacaacaaaaagacaaatacaggccaggtgtggtggctcatgcctgtaatcccagcactttgggaggcctaggtgggtggatcacttgaggccaggagttcaagactagcctgggcaacatagcaagacctcgtctctacaaatatatatttttttaattagccagttgtagtggcatgcacctgtagccccagctacttgggaggctgagatgggaggatcacttgagcctgggtggtggaggctgcagtgagctgacatgacaacactgcactccagcctgggcaacaaagcaagaccctatctcaaaaacaaaacaaaacaaaaagataaagtaaatatggaaaaattgctaataattattaaatccagttaatgggtacttgcgtgttcattatatcactctctctatttatatatatgtttcatattttcccataataaaaagtcaaaaaatggaaatttttataacaaaatgcaaatctctagttcatcttggaaaatcaagagttggctgggcacagtggctcacgcctgtaatcccagcactgtgggaggttgaagcgcatggatcacctgaggtcaggggtttgagaccagcctggccaaaatggacaaacccctcctctactaaaaatacaaaaattggctgggcgtggtggcacatgcctgtaatcccagctacttaggaagctgaggcaggagaatcgcttgaacctgggaggtggaggttgcagcgagccgagatcatgccattgcactccagtctgggcgacagagcaagactctgtctcaaaaaaaaaacagaaagaaaaatcaagagttgtgctaacattaaatccatgtttctctggggcagccattagctaggaaggggcagcttcccccaagagggcttgcagagaccggggagacctggttcccatggtcccaccaccctctagtgagtaggacacaagcctgcggcctgcctggcccctggaaccttttagcttgtaacgtcagactctcactccaccaggcattcaaagcccgtactaacctggccctgggctgccttctcggcctcatctctaatctttccccacccattccagcattctggatgactcattgctcccaaaatacatcacgcacattcctaccttcatgtctttgcacatgctagttcctctacctggaacgacctttctctctcttttccacctggcagactcccaaccagaggtggcccctgcagggagctttcccagacctcctctgggacagctagttgctctttctgttggaccccatcaatttcatctccttcctccctctccaccaccaactgtccaatccctgcatggcttcgccctcaacgtgggggtctccagaggacgctgcccacactgattcaccactgggtgtccagcgccctggcacaagcctggcacagggtaagtgcttcttaaagtttgtgaaggaaaaccaaccgaaggtcagatcgtggttaagagcattctagaaccaggtcacctggcttcaactcccagctctgccatgactcagctgtgcaacctgtttgagaaacttaacctgtctgtgcctcagttttttcatctgtaaaatgagaataacagtaccttcctcacagggttgttttgaggattaagtaaattaatatatccccactgggcacggtagctcacatctgtaatcccagctcttagggagactaaggcaggaggatagcttgagccaaggagttcgagacctacctgggcaatatagcaagaccctgttctccacaaaaaagggggaaaaaaagttaatacatgtaaggtacttaaaatcatgcccggttcccagaaataaggactagatgaatgcatattaaataaaaattaaataagcaggctcaaagatgggcaattaccaagaccctccctgagacctggtccagtgtcaggccctcttccctctggtgacctgtgtcccccatggtgtggaaatgagtgttggcagtgcagaatcacagcctgaagtgacaccaagtccattttgctcattagttaaggaaaaggcctccgtgggtgcctacggctctttcataccagtaaatctcttgccagtttctcttttaaacaaaaagaaaacaaactttaggctcagtgcctttgggcatcaatagtttgatgtggaacttgaatagcattgttctgttttcagaacttgctgtgatattgatttcgcattttcaatagtgattagaaagtcttccttttcaataaatgtacttacgtatttttaagtaagttgattcaaagatgaagattaagacagtaagtagagatggtgtgtgaaggtaacaaaaactgggactggggcctgcagaagatgaacatttgggaagcacagttgtagggactgagagagaagacagggccttcccttggggcaatttcattcttgggttagtacagaatgacacaggattgataataacagcttacacctccttgcatgctttccaagcaccggccctttacatgagctacttcttttactctctgcagcattactttcagggaggaggtaatataattcccatttgattaaacaggaaagtgagcccagaggggtgaggtaacttgcctaaggtcacacagtttataagaggctgaagccagattcaaacctaggtccatccaatgccactgcccatggactacataggttcctgctcaccagagaaattcagctcccagcaactcaaaaaaccaactctaagctatgatcagcttcggagtttccagagccagcatggggaggagatggaggtggggggctgaggggatagaagacagacagatgccaccctggtacaaaacctgagatgctccaaacctcacaccctaggacaactgagaactcagggccatgccctgcctctgccacgggggcacaacagcaggaagactagacaacagcaatggcagctgatgcttacagactacttcctgcttgtcagccctgtggcgtgtgtatatacccttcgtatagaggctctgcttcaaccttgtgaaaactctttgaggtgcgtcttctagaagttagaaatttgaggtctggcgggaagaaaagatatagcaagcaaggggctgagtctaagccttactcttaacactcactgtgctccttccagaaaacaagcatttgtcagggtgttggcatgacaacctgaaaactttaggcgcctccccaaacataccagcttccctccacaatccagtatctatgaccttaaaaggcatcacaaaagagttcttagctacaaaatcagaagacataaatctagttccctctcgatcgctttgtggctgtgagtatatctgtatccttttctgcacctcagtctccccaactgctcagtgacagggttgggactactctgagggcctgaatgggtctacagcaacactgtccaataaatataacatgtatcacattgtaatgttaaatgttctagtagccacattcaaaaaagtaaaaagaaacagtgcaattaattttaataatgtattttgtcaaagctgatgtatctaaaatgtaaccatttcaatatgtaatcaatattttaaaaatgattaataggttactttacattcttttcatactaagtatttgaaatccaggatgtttcacatttacagcgcatctccatttggaccagccacattccaagtgcccagtagccatgtatggcaagtggctaccatactggacagcccaggtctagaatctttttcaatccatagctcattttacagggaagagctgtctcatctttctcccttctcttagaaaagatgtcctgatcgtagcctccgggctgacaaattccacatgagcccggagggaggagctggaagccacaatggagagaaagcccgggcctgcctgggtgtgaagaggctgtggctgctggggatgctttctgtctctccacagccaaattactcatgaagccccagggatggggagagtccctgcggaagatggccacaatcctgcttttcctcctgaccccaaaattcccttaattggaaattcagtctgagcttgaaacccatccaggcagccacctccacccatggcaacatctccatgggcacgcaggactcctgccccagacacacaaggaatccaatcccacagcagcacctcatgcaagaggctggatcccagcttctcagtccccaggctcacttcccggctgtgggcctggcagccttctcggtgggagctcaaaacctccacatgcaggggcacaggcattggcaggaaggaccaggagggcaaggaaaataagggggcatccctccttctccccagacttccacttcctcacctttaaaatcaaatgttgttagatcatagcaatgattgtctttatgctggctgccctgtgccaggcattttacaggcattagctcgcatactccttctaaccaccctatgaggaaagaggatcccagggtcagagtggtgaagcaacttgggcaaggtcacacagctcttcagaagaagagctggggttccaattcatggtcttctgaatcaagaacctaagctccttcctgctgtgctctgcctaagtggcccagggtgttccaggacagtccgagcttacacttgtcataaccagatatatttagtgtaattatttaaaatgttccctttggaagaaggagcaaatcttccatacagaggaattttaaataatataggtagatattcccccctccaaaaggtgtgcctgaattccagacccttctccctcttgagtgtgggctgcactgagtgtctgaattccaaaggatggagcgggaaaagaggaaatagtaactgtacatcagagaaacctggctgacccaccttagccaagtgatcaaagttaacatcctcagtttataagaaacatatcagacaaacccaaattgagggacactctataaactatctcaccagtactcctcaaaactgttgggctgggcgtggtggctcacacctgtaatacgagcactttgggaggccaaagcaagaggatcacttgagtccaggagttcgagaatagtctggccaatatggcaaaaccccatctctattaaaaatacaaaaattagccaggtgtggtggcgcacacctgtggtcccagctactttggtgactgaggcacaagaatcacttgaatccaggagatggaggttgcagtgagccaagatggcaccactgcactccagcctgggcaacacagtgagaccctgcctcaaaaaaaaaaaaaactgtcaaggacacacaaaaaaagcaaagaatcagaaactatcacagaccaaagggaaccaaggagatctgacaactaaatgcagtgtatgatccttcaggaaatcctgaagcaggaagaagacattgatggaaaaactagtgaaatgcaaataaagtctggagttcagtgaagagtcgtgtgccatgttggtcttgacaaatgtattatgataacgtaagaagttaacaataggggaaaatgggtagagtgtatggaaactctttgtattctttttggaacttttctgtaaatctaaaattattcccacctaaaagttttatttttaaaaagtgctcccttttactcacagaagtgttcaggtttagacaataaattatatgagcacctggtcataagcctggtcctgcctgtcttagaccatctgtgccactttaacagaatacctgggaccgggtcatttgtaggggaagtccaaggtcaaggcaccagtgggttcagtctctggtgaggccattgtcttcctccaaaatggcacttcgcacactacattctccagaggggaggaaggttggatcctcacacagcagaaggcgggagtgccaagagacaaaaaggggtcaaactcaccattttataagggatttaatcccacccatgaggattaatcacctctcaaagattagtctcagaactaatcacctcccaaagttcccacgtcttaatgttacaatgacaattaaatttcgacatgagttttggaggggataaacattcaaactatagttgcctctaaccaagatgttttaagaaaatcacccataccttctgtccccttcagtgatgccaacggctcacacacttatagcagtgtaaagtttacaaagtttagcattagcaagatgtgctaaagtttttgaatcagaaagctagaggctgatgcttgggttctcccacttgcttgccaggtagtcttgggcatgttacattcattccctgggcctcagtttccatgtctgtaaaatgaattcattgtacgatgacaatgactagtcatatttttcaagccatgtctggtgtccgacactgtagtggtgactctgatgggctacccagattccccttcaggactgaaggacttatttctcccactcccagctactcagagagttgccagctgtcagccctctccagggattgcccttggctgaagagagctgtccagccctagtcaagcctccttctggagggtagcctgcatacaaatgaggagagtataaaagatccagctccctcatcccaacttgcgatgaccttgaaggtcatctccactgcagagcatcccttatggttggctgaggctttgttgagactgtattgcaacccaatgtctcccaccgcccagtccggccttcttcccttccccacaagtgttgatccagagggtgctccctgtacatttcctgcatgttaatcttcatctctaagtctgcttcctggggaactcacctcacaataggattgtgagccacctgacctgcactgtcgttcctaacccttagaccaacttgtctttatagatgagatcattgagattagagaagaaaatggatctggccaaggacatacaactaagaaatggcggtgccacagatggagaaactgacactcagacaggccaactgatctgcccacatcaacgagctaaaaaaatggcaaggccaggatttggccctaggcctgcttaactctgaagaccatgtgcccagtctcctgccaggccatttacatcctcaggaggattgctgcagccccaggacaggcgattgccttttaccaccctcctgccagaccacactgctgctgtccctgctcctgtaccccacttttgctgggttgaaaaggttgaaaggggtaccccactgctgctgtaccccaccccaaatttgcaaaatgagaataagaacagtatctaccttttcaggatcttgtaagagtaaatgagttaatataggtaaagacctcagaacagtgactggcacatagagaatcctatttaagtggtgggttaaaaacaaatcatgtaagtcatgtaaagctgcacctgtggcgcgctctaaggacagaacggcagctgccggtggacctcatccgctctctaagggagtcaggcttgacctgagccctgaaggaggagtagaggttaagtgagtggcaaaggaaccagtatgaacaaaagctctgtggcaggaggaactaaagaaggaagaactagcacagagggaagaaaactccaggctcagggaaagaatgacaaaaaataaggctgggtaggagggtgggaacctgattagaaaaggccactcactaactgagtgattttggacaagtcaccttatctctctgagcctcacttagctcatctgcaaaacagaaataaacacagtacctatcataaggttgttaaagggactgagtgagtccatatttgtgaaccacttaaaattgccttgtacctagtaggtgccataaatgtttggagacaacattagaactttatctgaagcacaatgagaagacttaaaggggtttgaatgtagatgatagggtgggtgtttagtagatgggagggtggatggacgcatgggtagatggataggtgggggaggttgaatgaatagaagtttggttgagtgatagaggtggctggctgggtagctggatgaccaggcgggtgggtgggagtggatgttgttttaatgaacagaagtgtcgctgggtggataaatggaagtacttgagtgaatggatgcgtggctggatgttaagatgggtggctgggcagctggaagcagctgagtgaatgcaggtgattggtgggtgaggggacgggtgagtggttgaaagggtatctgtatgtttgaatgggcatctgggtagttggacgggtggttgagtcgatgaatggatgggtgatgagctggttgagtaggtaaaaggatgaaaaattgggtaggttgcatggaatagataagtaaatctttgagtgaatgggtggttgttcaggtagatgttaggctgttgttcaggtggatgttcaggtgtgatgtgggactggaggtgggtgtgtgggtggaggggttgttcagtgagtgttagagaagttagtcaatgaaggaattgggtggatttggatggatgtttgggtggttgactgcgaggttgtgtggatagatggatgactggatgactgggtgggtaaacaggaagtggaatgggtaggggaatggagtggatgactggagagatggctgttcaggtggatattagaaaggttgggtgagtggtagggttaagtcagtggaagggctgggtgtaactgagtgatggatggatgggtgagtgaacaggagccaccagctcccgaagagcctccaattaacccctgaaggtgatgggggtaaaagaagcagaatcaggcttggagacagggcctcctaggttgccctgccccaggacccccttctccgaggggaggcgaccccttcccacccccaccgctgtcctacctggaggcggcaatctcggccttctggcgcgcgatagcagcggcgcgctgggcaccctccacactgtgctccactttctggcggaccttgttgctcttgagctgcagcatgcggcgcttggtgtccttgaccagcacgttgtggcggtacttgccctcctcgcggtggccgtcgggcagcgtggtgcagccatagccgtggcgcaggttgtccagccactcgccctcgtagcggaggccactggagcgttcgctcacgccgaagcccgagcgtttgtcgttcttccactcgcccatgtaggtctcggtggtggtggcgtcgatatcggcctcgaagggtgcggcctcgtcggcgccctcggcggcctctcccaggctggcggtggacgcggcgtcgctggcgcccgagctgaggtcgctcttaaggaagctgacacggctgcgctggctacccacggacgtgcgcgactctgcgcgccgcagcttgcccagcagcgcgccccgctggaagaggccgccgcccttgggcgcccgcgcggccgcctcggcattggccaggaggctgagcgcgaagccgccacgcgggatggcgggcgagggcagcgcggggccgtcggaggccggcgaggcgggagagtccggggccaccgtgccgttgctgtgctcgctgcgcagggacgacagcgacgtgcgcagcggcgagcgcaccaccacggccatcccgtagggcacgctctggcgtactccgtagccatggcgcatgccgttggtgaactggccttggtacgtccctgcgggcgaggagagggcgcgtcagtaggcggcacgacgggtccccgcgtgtgcacggtggcctgggagggcaagggcgggagtgggcaaggcggggtgggaccgagaggcgcaaggccgtctgagggtcagggtgcacagtgctatgagtgtttgagtctactcgagtgtgcaataacacgagtgggtgagccaggaggagcttgcacgatggtaggaatacgttggtgggaacatggcaaggtcacaagtcgtgaacggataagctagtgagttcgcatggtagtgcaaatgttggagagcatgggcttgtgtgtgtatttgtgcaagatcgtgcgtacaagacacttgtgggcgtgcatatcggtgtcttttgactatatgagatcatgaggtgggggcaggtggctcacgcctgtaatcccagcacttgggaaggtggaggcggatggatcgcttgagctcaggagttcaagaccaacctgggcaacatggtgaaacctctctctacaaaaaaattagtcaggcgtggtggcatgcacctgtggtcccagctactagagaggctgaggtgggaggatcacctgagcccgggaggtcgaggctgcagtgagccatgattgtgccactgcactccagcctgggctacagactgagaccctgtcacacatacacacacacacacaaatcatgagtgtgcagggtagtgtgtgcacagtggggtgagtgcctgagatctcacggagttgacattatggatgtgtatgaggttctgagtgtgcaaggctatcagagtgccaaagaacaaagtaatatgtagcactccaggctgagtgtgtgaggtgatgggcatcagtgaaaccgagacactgagaccgtatgaaaccatatggaggaaggctagtggtgtgtacaaggtgtcggcaacttaggccctgcatgtacacaagtccatgagctcctgggattaagatgccttatgttagcagccatccaagtcttatgtgtgtggagaggcagcagggagtagtggttcagagcacaaactccagagccaggctccctgggtccagatcctgcctctgcccttactagctgtgtgaccttgggcaactgacttaacctccctgtaccttagcttccttatctgccagaggtaataactgcctcttacctcctagggtttttttttgaggtttaaatgagttaatgtctccgaaaaactctgaaagcaaagatatgtgtgtgatactgtgattctacaaagttgtgctcacgtgtgaggtcacctgagttgtatgacaagctgatacacagctgccaaaataacttcatccttcacccccatcctgacatgtagttctccccagggctcatccaaaaaccttctcctattctctctagatgactgcacatctagtgtttttaaactgccatttatgtcctgctgacctccccaaatatatccccaacccctccctctcccttcggtagctccagatgtcaccttggaaatttgtgttccctcagatggtacacagccacctccagctcacatctgccctcactcaccccacacacacacctgggccacagtcctggtctttctttcccacagcagtgctgctgaaaggcagttctctgccttcgtctttgtacctccaccatgtagaacggtacctgatacataacgttcactgcaccgaaggcagaaattctgaggcttctttgttttaaacacaagctgatacattctccctagttaacaaaaaccaaaaggtcttcctgctaataaatgtccaggagcaagatggctgagtagacaaccaaggatgggactcctaaactcaccccagcagatctgctgttgcactgctcttccctcttcctggaactcttttcctccagatatccttcaagtctttgctcaatgagacctactctgaccccctgtgatggttaatactgagtattagcttgattggattgaaggatgcaaagtatcgatcctgggtgtatctgtgagggtgttgccaaaggagattaacatttgagtcagtgggctggggaaggtggactcacccttaatctggatgggcaccttctaagcagctgccagcaaatataaagcaggcagaaaaatgtgaaaagcctagactggcttagcctcccagcctacatcttcctcccatgctgctggatgcttcctgccctcgaacatcagactccaagttcttcagctttgggactcggactggcttccttgctgctcagcttgtggacagcccattgtgggaccctgtgatcgtgtgagttaatactccttaataaacttccatatatatatatatatatatatatatatatatatatatatatacacacacacacacacacacacacacacacacacacatcctattagatctgtccctctagagaacgctgatgaatacaccaccctgtttaaaactgcaatctgcttatttcacattgcgtgcctttatcaaaacatctcatataccccataaatatttaatatatacatccattatgaacccacaaaattttttccaaaattgcaatctgcctgcacccccaccaccctgctcacttatctacttttccttatttttcccatagcacgtatcaccttctaacataccatatgacttatttattacattaattgcttttctccctctgctaaaatggaagctccatgagggcagggatcttttctattttgttcttggatggattccagaacctggaacagtgcctggtacacagaggtgctccgttaatatctgcaaaatggctgactgactaaacctgttcaaaaattccatctcattgggtgaccttggcaattccttttcttaacacctccattgtctgcctgtcaatgatgtgttgggtgaagagctctccaaggcttgatctaactctgagatgctgagcttctaggaattggtgcactgtaactttggaggcgaaggagggcacatctagatgcttccacactgcctggtccctcccagcacattgagctcaggatcccacttctaccccatcctacctcttctgcatgaagagcccccattaaggatcaagaacccccattaaggatcatgtacaatgccaggggctcactaaacctctcaacagtcctgtgaggtgagtcccatgataatgcgaatttccaggaggatgctggtgatctgagaggttaagcaatttgaccaaggaaatgggatccaagcctaagcctgtctgatgccagagtgtatgctgcgagcccatggctcttaatcctggtgtgcattagaagcaccagtgaaactttaaaagaaaacaactgatccttgggctttaccaccatcaattcctgtttattctgttggaaaaggtccctagtgcttccagcccctctggacagcaagaaagaacagccaggagggagagacacctgggctctgttcccttcaatgaccagcctcaaaaaaccaaggatcatggaatatcagcaataaaagggctaaagagaaatggagagagacagaaatggagaagaaagcattgggcatgatctcatagaggaagatgcaaatatgacctctatttcataggtaggttgatgttcagagaagttatgtgacttgcccaaagtcacacagtgagaaaggagcagaactgggatttgaactaagatccaacttaagctaaggaagtggaaaatgggattgtatgacaggtgcaatgaacagagaaatgggaatgtggtatagctgatgaaaaatgggaagttggatagatgggaaaccaacaggtcgcatttcccaagctcattcacatgtgatcccattggatggaggctgaggacagaatggaatgtggagtcatcctggcttcaaatatcatctaagctggggaaccttgggcaagttccttcttttgatcttagtttttttgtctggaaaatggaaaagtaatacccactttccaggggtcttttgaggattaaaaataagacaacaaaaaatggaaacaattcaaatgtcagtcagctggtacatggataaactaacacagtgaagtgctagaaaagagagtgtgctagaaaagagaagtgctagaaaagtgcaagaaaagagagcaggctgctgttacacacaacacatgaatgggtctccaaaacatgctaagtgaacaaagctagagatgaaagctgtgtgactccagttacatgaaagcctcaaaaaacaaacaaacaaacaaacaaacaaacaaacaaacaaacaaacaaacctatagtgccagaaagtggatctgtggttgccaggggctgggtgtggaaggaatagaatgcaaaagggcacagggaaacttcctgagttgatggaaatgttctgcaccttttttttttttttttttggaggtcgggggatggagttttgctcttgtcacccaggctggagtgcaatgttgcaatcttggctcgctgcaacctccgcctcctgggttcaagcgattctcctgcctcagccttctgagtagctgggattacaggtgtgtgccaccacccccagctaatttttgcatttttagtagagatggggtttcatcatgttggccaggctggtctcaaactcctgacctcaggtgatccacccaccttgcctcccaaagtgttgggattgcaggtgtgagctactgcgcccagccaaatgttctgcatttgaattgtgctgatggtttacacaagcgtgtacatctgtcacacctgtacatttcaaatgcattttatcatatggaaattacaccttgatacagttggtttttgtaatgtaaataaataaattgtaaagaagcttttcaggaaaaaaaaaaacaaaaaaaacaacccagcatagcattctgcaaatatctatcaggaaagtcatcagctctactttccaaatggatccagaatccagccgcttctcaccacctccacttcgactagagagtggtctgtgccaccgttctctctcacctggattttcatagtgactgccatactggtctcctgattccactcttgcccctctatccatccctaacacagcaatcagagggattttgttcacatgtgttaagtcagattacgacactgcactgacccttctcactcagaagaaaagctgaagtccttagtgacccacaggccctacctgacctcatccccattcactcctctgtgctcctctcccgccatcctcccctttccctcactgcactctagccacgaagactgctttgctgctgcacaggggccatggaaccacctcagggccttggtattgctgttccctctacctgtaatgcccttcctccagatacctacatggctcaccctcttgccgtcttcaagcctttactcaaatgtcatcttctcagtgaagccacccgtggccaccctacttacgattcaacccgtgcccaaggtcttctatctcccttccttgctttatttttcctagagcatatctagtgcaacatacattttgctttttcttgtgttattgaccatcccccctcactggcatgcgagctccttaaaggcaaggattcttttctttttttgttcactgtggtatcctcagtgcctcgaactgtgccaaataggtactcagtaaatatgtgttggatgaatgaatgcatgaatgaacagcaggcattccgtaactgtttattctcttctttctgttttgtccatctgcaaacagctctgtggaaatgacagctccggggaggtattttatggttcctgttttacagatcagaaaaaactaaggcccatcaaggacaaaggactcatccaagatgacacagctaataaatatgccagagccaaactcacatccgtgtctggctatgctcctctacttctcagaagaaatttttaaaaatgaaagggaaaagtgaacaggcagagagcagagaagatggtaaactgggagaaagagacaagacatctaatctctgggttggacaactttatgaaattaaatcaaccaacctacctttagcttcagtttggcatgagatgggctgatgtagtccctttaagcccaagaaaaactgagattgcaacaggagagcagctcttggccaccagttgggaaggaaacagtcaggctatattaggaaacttacaagcaagtggcaagaggcacagacacccaggggaggctgggagtgacagggccctgggaaggggaaaaaccgactcctgaggccacccccactccaactccctccaagacaggacagttctccctggagacaggaagaatgcatccacagagggagagagggaggccgctgcccatggccatctggctgagaggggccgtctgcagaaggaagggcctcctccgataccctttggactgcctcctcactgagctttgtaaaccctgcagggcttcccactgtcccaaaggaaacgggggagatccccaacagcccacaaaacctggcaggggccgcccctgccacctcccctgcctcatcttggactgctcaccactcacactcgccttcccaccttggggcctttgcacaagctttccccatttcttcacatgctcttctcttccctcttcccctggccaacttctattgacagttctagctttggcttaaacgtgatttcatccaggaagatttcttgagccccattccctgagtgctgctggaaacagccacatgttatcatgtcatccatttttcttagcactttccacaggtgccattgaataattatcatgaccatttgttcaccagaagcctcccctgcttgtctttgccttccaagagggaggaagctttgtctaccttattcttgctaagatgctaagctcctggcatctagcacagttcccaggcccaaggaaatcctcggtaagcatccgatgaattttcaagtcttttcctgaatgacactcttatgtcctttgagaggcaggaaacccatcttttttccctcatgactcggcatgcagtaggtgctcagtagtggacagcactggctgccaagggtgttcaggtccagattcagcagttcaagccctgggagttattggtgtacatgtaaaatgctggtgaaggccataaccatggcaaaaatacggtcctgtccccccgataggactcccgaaattaataaaacctaaatatagccttctccttgcagttgctcttctggtgagtatagaataacagggatttaagtctaaactctgacgttgaatagttctaagacatgcataaactatttaagcctgcggagcctcagtttgtcattctgtaaaatggaaatcatgataccttcttcatctggttgttcatacaaccctttgcatttgacaagctagatgaagaccatgcattcttctagctaggtgctgggatacagccgtgaactaagtggacatgatcgctgccagcaaggggctcagagtcttgtgccagggatagactaaatataattaaccaatcacagaaataaatgcagccatggcagcagtccagatgagaggtgatgccccaggtcttgagtggcagggagtggggagggtgggttgaagattaaataaactgtgtgtgaggcagctagctcagtgcctaggatatagtaagtgttcaataaaccctagatttttgacaggtcagagtctttgcccagaaaggattaactggaaagatgaaaaggagccacacagaagacagagagagctcaggaagaaaatgagaccagctccaattttctgcccggtttgtaagttgtttgtaagaaagcatgtttgtgctctggaatactcagattttgaatattccagaatttttaaaaattcacacaaaaagaatggaaaatatctcattaatgattgtatattgtttacacacaaaaaaaatattgtggataatgagttaaataaaatgtattattaaaattggtttcacctttttaaatatggctactaaaaatttttaagttacatacatagttcatattatacttccattagaaagttctggtttaagtcatttggagttagggttttccttgacctgcagacaaaagagtatcttaatggatacaggtaacatcattttgattttacagttggaaaagccgaaactaagaattttaatgacttgctcatattaacacaatgtggcagttgttggcaatcacagccaagcgtcctgactagtgctttcacctctaagaatatgagaacttcccttacaagttaaaagttccaaaattctcacccaaatctcagctctgaagaaagcgtgaccatttcggaaatgcaagtgctatggttcagatgtttgtcccctccaaacttcatgttgaaatgttatcctcagtgttggaggtggggactaatgggaggtgtttgggtcatgggggcagatccctcatgaatagattaatgccctcccttgggggtgagtgagtttctgctctgttaattcccacaagagctggttgttacaaagagcctggcaccttttcactctcactcttgcttccactcttgccatgtgatctctgcacacaccagctccccttcaccttctgccatgagtggaagcagcctgaggcccttatcagaggtagatgctccaccttgaactttccagccaccagaatcgttaatcaaataaaccttttttctttgtaaattacctggccttgggtatttttttttttttttttttttgagatagagtctttctctgttgcccaggctggagtgcagtagtgtgatcttggctcactgcaaccaccgcctcctgggtttaagcaattctcctgcctcagcctcccaagtagctgggactacaggttcctgccaccatgcccagctaattttttgtagttttagtagagacggggtttttcactgtattggccaggctagtctcgaactcctgacctcatgatccgcctgccttggcctcccaaagtgctgggattacaggcatgagccaccacgcctggccctcaggtattcttttacagcaacacaaaattgactaagacaccaaggaaaagctgggagatccagaatccagtttgagacatcaaagagacatatgggccagaccaggattctgcctccaaatacagaatggacactgagaacaccatcccatctggccagtgacaccttcctatttccagggaactatctgaggttggaagatcagtgtgcctcggtgctacggtttaatgtttgtccccctaaaaagctcaaattgaaacttaatccccaatgtggcagtattgagaggtggggcctttaagaggtgattaatccactcatggattcatggtttaattggttatgggagtggggctggtggctttataagaagaggaagagagatctgagctagcacactcggccctctcatcacatgacaccctgtgccaccttgggactctgcagagagtctccaccagtaagaatgccactcctgatatgaccccttgaccttggactgcctagcctccagaactctaggaaatacattttgtttcttataaactacacagtttcaggtattctgttataagtaacagaaagcagactaacacactggagaactgaacagagatggagagaaggaacgaggactagctcctttctaggagtccccattgcctatagaagtccttacctgatagtccagttccttcatgacctggttccaagtcactttctcagccttgtcttcccaaatccttcatagcccagtttcaaaccacctccttcagggaaccaccttccttcctccaaattctcattgcccaagacatttatcacttcttacttcccatggcagctctcttgtctttatcttgcctgttttgtctaccagccatcgctgatccttctccaagtcctctcacatagtaccagatgttggcataagatctttgggtggcccatagaagtgtcatcaacaaatttcagacagtgtttaagatggagcatggcagatacagagtgagcatcagagagtccaggggttaatggctcttgtccaagcataccaagatcagaccaggtgaaccagaaatgctcactgtggtcagcacacatgcccatgccacagacaccacacagatgctcctgattataagggactcatagcttggctctaacccaccttgataaagactatggacccagcatcccagagaaagtaagccagggctaagacagctttggaggtagcaaagaataatggaaatcacatggtcttcagatagacctgactctgaatatctctttaattttgctcaatatattgttaaaatgaatagataagaaagtatcctaacagatacaggcatcatcatttcgatgttacaattggaaaaactgaaactaagaatttaaatgactctcatgatgacgcactgcgatactccttaattctcttggtctccaccctatctgtctagtccaagccacatccttttctccctcgatgatgacagtagtatcctccctgccccccacttcagttgaccctttgctgctgccactcatcttcttcataagatgcaactctcagcaggttactccccatctcaaaaccctgcagtaacttcccagtgccttgaggagtgtctcaggtcaggatccctagggaaaagattctgaagctgagatgatgtgtgggagatttagcggggagtgctctcaggaagagcacgtgtaaggaaggaagcaggatttggcagtggaggaagctgaacatctgcaacagaatattcaactgatcccagggggatttaagctggtatagcccttcagcgttgcccaaaatcaaagcaagggggccaggtcattacagtcattagatgtgaaggaggcagctccctttgttggagagaaatacccagccaggatctgtcagctgctaacactcctggcagctcggggaatgtgtccctggtcctaaggagtgtctgaaggggtagcctagaatctactagaaggatgaagttcaagctcctcactgtgacccacaaaaccctcatgatctgggctttgccaatctctccagcctcgtccaccccactctctctctctgagtctgtgctccagccttttctggaacacagcatgctcaggtcccacctccaagcctttgcatttgctgtcccttctgcctgcctgtgcggcctcccctgtcacccagtttacctctattcatcctgcatatctcagctcaaacatcacttcctcaaggacgccttctctgattatcagaccagaccaggtttccctgttatcagttcataaattcttctatttttccttcaaaatatgtatcacattttgtatttaagtaattgttagatgccggtctctgctgttaagatacatgcacttgggggcagggacaggtctgactcgcccaccacagcatccccagcactccatgcagggactcacacatggaagacattcaacagatactgtcaaatgcattaataagcacaggctttgaataaggtctctttgagtctgtctcctctcagtaaagtgagcatagcaagtttcctttgcaaggttgctgtattacatggtttatctagcagagatctcgggctctcaacaaaggttggctcctttcacttcatgggaaaagactgtagggtgaccagtcatcccagtttgcctatgtctgagaggtttcctgggatgtggaactttcagtgctaataccgggcagtttcaggcaaattgagatggctgatcaccctaaattggggtgagaaggaaaaaggggcatttcatattagtacaatagtcaggatatagtagcaaaccagctctttaggacaaaccaaccaaccaacctcagtttgtactattagtcagtttccactgtgtaaatacccccaccatgactgcaaagttcctgagctctcatgagccagtaggagctggctctagtaacctgtatgtgtgtatatataaatattttttgttttgttttgttttgtttcgtttcgagacagagtctcactctgtaatccaagctggagtgcagtggcacaatcacagctcattgcagcctcaacctcctgggctaaagtgatcctcccacctcagcctcccaagtaactgggaccacaggtgcataccatcatgctggctaattttattttttgtagagatgtggtctcgctatgttgcccaggctgctcttgaactcctggactcaagcaatcctcctgtctcaacctcccaaagtgttgcaatcacagacaggagccaccaagcccagctcaataacccatatttaatatgagctctcaggtttctattgcaaatgtgccacacagccatagacaacctcaactgtggtgcaagtgagaatatttcaatcctgagaaggtcacagctggagtggagcttggagattaaaaccgcttttataaaacttatgacagtgaaaaaaatctgacataaaaatatttaacagtaaaaaaaatcgatataactgactccatcttacttctaacctcacaagctaactgtcttcactcatgcctggacatagaccaaactaactattcaaaaattgagttaatagtttaagacaaaaataattaacagtcctttcttgaaactaaccccctctttactcagtgaccaaaactgcctttataaaattatgactccagagaaatatagccagaggttacagaacttgtaacctccccagcgactcctatagataacatcactactgtcaaaacctaaaattggcctttaaaatattttttgaacttttacattctgacgattctacccagacctgtgactcatagcaaaaaactaattcaaccagtcctataacccccaccccgaaactgcctcagtataaaaaagccagcttcgacttcctataatttcatccccaatccaaccaatcaacatttccctctccctagccccctgcccgccaaactatccttaaaaaatgctaccttccaaactttcagagacataaatttaaataataaacccccatcttcccacttgactagccctacatttattaaactcttcctctacgataataccattgtcctaataagttaattttatccatacaacaaacaaacaaaggctgggtgctgtggcttacacctgtaatcctagcactttgggaggccaaggtgggtgggtcacgaggtcaggagttcaagaccatcctggccaacatggcaaaatcctgtctctactaaaaacacaaaaattagcctggcgtggtggcgcatgcctgtaatcccagctactcaggaggctgaggcagagaattgcttgaacccaggagacggaggttgcagttagccgagatcgtaccactgcactccagcctgggcgactgagagagactccgactcaaaacaaacaaacaaacaaacaattcatcagacgatgataagatcttctagtccaagcccataagtaatccatcacataggccacttattccccatcctgtgtccacaactgacattgctaatgggtcatgaggctgagtagcactatagcctacagtccccactcaccacttccgcaggtagccacacccaattagccagtgttgtgcgtgagaaaatctgcttaccttcatgggtaagtgtagtcttattccttcattatacggggaaggaagcttaggctcagagaggtagagggacctgcccaaggccacacagcccaggagtagctcagctgggactgaagaacaggtcccttgcctcaattgctctttcaatgctgccttgcattgaaaagctgagtacccagagtagggagaaacaaagggaggccatccaggattctgaggctacattctggaaaactgtgcttagacacccccacccccaaccctttttgcatcctgagggctccttattacgtctacatgtaaatactgtttgtatggaggaagcactttttaaaaattgcaaaagttgggccaggtgcagtggctcacgcctgcaatcccagcactttgggaggccaaggcaggcagatcacttgaggtcaggagttcgcgaccagcctgtccaacatggtgaaaccccgtctctactaaaaatacaaaaattagccaggtgtggtggcgcttgcctgtaatcccagctactcgggaggctgaggcaggagaatcgcttgaacccaagaagcggaggttgcagtaagccaggtgtggtggctcagggctgtaatcccagcactttgggaagctgaggtgggtggatctcttgagctcaggagttcaagaccagcctggtcaacccctgtctctactgaaactacaaaaaagtagccggttgtggtggtgcacgtctgtggtcccagctactcaggaggctgacatgggaggattgcttgagccccccgtgcaggggtggaggttgcggtgggccaagatccctcctgcactccagtctgggtaacagagtgagaccctgtctcaaattaaaaaaaaagaaaacaaaattttaaaagtcatatgctcattgcaaaaaaaatccaaacaagagaagagtatataaaagaaaacacctttgtccggtctccccagggtaacttctgttaatgatttagatccttctaggccttttcctgccaatttgcaactgtatactgatcacaaatagactaaaagattagctgttcaccagtctgccactgaccccatctctgagaacactacctagcacctagcaggcactcaataaatatttgccaaatggcttttgttcacttataatggcttagatttctttctgtatgaatataggtgggtccacctctgtctttttaaagtcctgttgtacttcatcgcatggtctcataaattaacagtcccttcggtgagcatttagactgcgttacatttttcccgtaacaatcccaaggccttgctctctggctcgcctgcaaggctggcaccaaagtcccttcccatggcttccaaatgccgctgtccatcaaatctccatagtctctggtttcctgggatcaccaacagacaacccgaagcggaggagctggcggcatttgggaccagctcccaggagcagggtcaggttgcagcgggtggatgacaagtccctgagcccgcaaggctccaccacccctacatccagaggctgctgccccagatgatgccccgtggctcacccccagaagcaggggattaaccaggaggcatctcctgggtgctgacagccctggagcctgtggcctggggaaaaggcccatttccaggccttgggtcagctcagcaaccctaagggccttggagagcagaaatgattgtgtgtgcagaaggcaagaaaggtcaaggggagagggtctaaaaggagacccacctacctgtgcacaggcctgcccagaaacccaatgcccatggacacttccaacaggcatctctcacccatggtgtccagtactgaactcctgacccttcctcctcaaaccctcaccccatctcagttcatggcaacaccatccttccatggttcaggcaaaagccttgggaccatctttaactcctctttctctcaatcctatccagtctataagttttgcttcaaaatgtgtcttctcaccacctctgctactacaaggtagtggtgcaaaccaccatcttctcaccagtcataatgtaataaactcactaccaggtctccatgccacctcccctcacctaatacctattttcccaaaacagccttttctcaacacaagagctaaaagaatctcatcaaatgggtcagatcctatctgtcttttttttttttttttttttttagagatagggtctcactgtgttgcccaggctggtcttgaactcctgggctcaagcaatcctcctgccttggcctcttaaagcgctggccttctctgtacatcccatcaagggtacatactgtaggtttgtctgtcactgatgatgttaaatttgatcactttgttaaaaggtagccataggccgggcacagtgactcatgcctataatcccagcaatttgggaagctgaggcaggaggatggctcgggctcagaagtttgagaccagccagggcaacatggagaaaccccgtctctacaaaaaaattagccaggcatggtgatgtgtgcctgtaatcctaggtacttgcaggctggggtgggaggatcacttgagcccaggaggtcgaggctgcagtgagccgtgattgtaccattgcactccagcctgggtgacagagcaagaccctgttaaaaaaaagaaaaagaaaaaaaaggtatccataaaggattccaatttaattaaaaatagaaataataaaaacatggtacatgccatccagagtgtcccctgcaggctgcatgcagctgtccagcctccatgtgtgactccagctctaccccatccacagcaatgggcagccagcagtggcaggaagacctccaggcacaaggtgctcattcctggcctggagcaggggtcactctggagttcctagcacacctgggctgctctgtggattctgccaggcacagatctgtgccaggcaactctcatcagttccctttaagcagggagtgaaagttacacgggagggaggtgtgccagccctaacttctctcctactctgtggcttcagctcgggaagggataggtgagaacaaggataaccctccaaggcaggaagtctatggcaggaagcaaccctgtccccctcgccccacaccccaccctcaaccagggccctcagaaaatgagactcggcattcctcatgagggtgtggagggcagggcctgctccggggaacagctgctgggcacggaattagcaggtcccggaaacaagcaagctcgatgaatcccagaagcctggcctcggacaggggcacgtctgcagagatttggccaatcgggcacatgaatcactgaaaacaaggccgtggacaggaaagactaatacggtccgcttttctgttctgctaagggtctgctgtgctctcctggggtctccatagaatgcccagaagctgccaagacagcagctcagctgactgtcacgctgatgcctggctgtgaactgggacatgagatttccaagatgaggttaaattatgctgattctacattcgaaatggaatcatgtctggcatggattccatctacactggcaggactcaaggcagaactaagcgaatcaaagtcttgtcttatttactgttccaaagtcaaaaactcgtttttgtcctcaaatatcctcccgaagacagtgacagctatggttcaggccatcctgaattaattcaccctttggaatgtgaaggaaatacgggaatatatattttggcatttcctatgtgccaggcatgatgctcagtgcttcattgtcttgtttcattgtctcgaccatattctgagggcgattttaacacatccctaaaggaaaaaaggaaacagaagctcagggaggttacatggtgcacccaggttcatatggttaagaaccggcacagctgggatttgaacccagatctgcctactctaagtctcagttgcttaaatatcacatgtcttcctttagtaatatcagattctctcagggcctctacacttgattttcaataacagtcaaactattttaagttaaaagagattccttttcacctgaaaaacaaaaacaaaaagatccactagaactaagaaattaactgagcaaggtaaaagaattcaaagtcaatatacaaaaatagttgtatttctataaactagcagtgaacaattgaaaaaataaaatgttaaatgccgtttacaatagcacagaaaataaaatatctagggataaaattaacaaaagatgtgtaagacattgaattctctaaaacattgctgcgtgaaattaaagaaaacctaaacaaatagggatatataccatgttcacgggttggaagcctcactgctaataagatgtccattctctcaaactgatctatagatttaatacagtcttcatcaaaatcccagcaggcctttttcagaaatcaagaggctggttttcttttctttgtttgttttgttttgtttttgtttttgagacagggtctcactctgttgcccaggctgaagaagctggttttaaaatggaaatgatccagaataatccaattttgaacaggaagagcaaagttgaagaatttactctgattttatgacaatataaagctacagtaaccaaggcagcatgacattggcataaagatagacaaactgatcaacagaaaagatattctattatgcaaataaataaataaatatggaagttaagttccttcaagcttatctctgcaaggaacatgtatcacaggcccagagaatgtgataccaggtacttactgctcagtcctccagcctggcaaaatcacgtaactcccgtgttcagagtcaattggactaaaattagctgaagtcataagctttgagcagaagaaagaaaactggatccagagcgcagaagcttgggtttttgacccaatcgtcataattaaacataaagtctcaacttttcagcatgtaacaataatagtagtagtagtagtaataaaagcactaacacatgccataccctgttctaagagctttacatggatcagggcctcatttaattctctcaacaaaatagaataaaagagaaaatagcaagcattgcacctaggaagggaaatcttgttccatgacggtttgtttcaattttacattctttttagatgtgtataggtatagaattacaatgtaaaatacatatttttttgcattcactgccagggaaggaataaaacacatatcttatagtgggattgcaattataacagtttacaagccactagggtagtagatgagagggttatgaggtaacccaagtgatacagtgcccataagacttttagccggagtctggtacatagtaaaggcatattaactagtagccaggcacagttattactattgtcaaggccagcttcatgggtgctggaaccatgcagtctcgtaggacccagcactcagaagggccctgcgtctgggttaatgctctgttgtccccatcttaaaattcttaatgattttaaagaaggggtccacattttcattttgcactgggtctcacgaattatgaagcatgtcctagtctgtatcattgtttaccatttattatttaaaatacttatttatattacaaaatgtttaatgatcacttattattatcaaattgcatctctgcttcttattagctggacgaccttgagtgaggtacttgcatgatctccatgtcagtttcctcatatgtaaaacaggagccgtaactacttctccatgaggttgttgtgtgaaggtttaaacaatacaacaggctgggtgcagtggctcacccctgtaatcccagcactttgggaggccaaggcagggggatcacctgaggtcaggagctcaagactagcctggccaaaatggtgaaatcccgtctctactaaaacaaaaagttagctgggcatggtggcacatgcctgtagtcacagctactgaggaggctgaggcaggagaattgcttgaatccaggaggcagaggttacagtgagccaagattgcgccattgtaccccagcctgggtgacaagagcggaattccgtctcaaaaaataaataaataagtaacataacatacctcaagtacctcaagtgctaggaatggtgcctgggacttagtaagcactccaaaaatattaactatctttattattattatatttattttatttttttttgacacagtgtctcattctgttgcatagcctggagtgcagtagcgtgatcatggctcactgcagcctcgacctcccgggctcaagcgatcctcccaccttagcctctcaagtagttgggactataggcatgtgccaccatgtccagctaatttttgtatttttcttttttgtagagatggggtttcaccatgttgcccaggctggtcttgaactcctggctccagcaatctgcccaccttggccttactgttattatttttattagctttatggaaaaaagtcaactttgggcttgattcttccagtgcacattttggggtgggattaataaagtcatcagtggttctggaacttatttgagccagagatgacttggagaatctgagactatgtgagaaaatgcctcccagaaaaacacagatagtcttgcacgtatgttcacatcacgcctgaagtttcagggtatttatgggtctctgaggccaacgcaggggccccaggaccaagaacctcagaaaataacaagcactaaggactctaggaggtccagagtccgcgagtgtctcggtgggaacagccagccagccacgcaacaggcacataactctttcagggctggggcatgtgcggatgctttaagtcagcagctgtttttagctttgctatatatggccaggggaggaatgagggctataggagggggaggggtgccaagcagcttacaacagggtttgggaggccagagctcctgcaccagccccaccttccccttcccatgcgagagctggagagcttatcctcagaccaaagagaaagcctagaggacagggaggggtcggcgagatgggaatgacagggctttgaagaagacgccaagtcaagtcaccttagaacaatgagtgtcaaactttttggaccatgacttgcagtaagaaacacactttacattgcaaaacacacatacatgcagacacttttaaacacacacgaactctcacacattgtgtgtgtgcatatatatgtgtatctcgccaactgaataaatctttcagaaaataatactttatcttattctctgtgaaatactccgatacttttctattctgttctgttctttccttttgaaaaatgcaggtcgtgacccactgaattgacttcaccatccactaatgcgttgtcctctccagtttggaagactgctgtttcctttgtagcatttgactgcaagaaaaggagggcagtgaagaagacttctgaacctttgaggataaaatgcaagtttcagctttatctcctagctggatggcaagttttggacctcccagcttttgcatgctctgtcctctcgtcctggagtctccctccgccctcgtcacctggctcactcctgcacatatgtcggggcttggcttgcagctgacttcaggaagcctccctgaatgcctgcgtctggtcagctgcccactctggctttgttactcccctgtctgtccctgcctagcacccaacacagaacagcaggacaatttcctgttagatttgctgtgaagacagggagcgtttcccttctgcttattcctacgccgcaggtgtagcgcggggctagctgcatcggagtccctaaataaatatttactggatgaattaataataggtaatagtaataagagcaaccaccatttactaagtactcattcatcccaggagaagtcttttgagagattaggataggtccattttatagacaaggaaattaaggtttggtgagtttaaataatgtggcagggccaggagaatgacccagggctgcctgactcccagccgttcctaatcacaggatcttatttgtccacatccccctcagtgatacccacgtcggggcaaagggtgagtgcagatccttaacaaaccctcaggggactgatgacaggttgattaaagagattttccgaagcagtggccacgtctaattttggagagttacacctcgtgtgtggcttgggaaagagaatctgtgaggtttccagggccgctggatgtggggtcatctcatctgggagaagtctggggctctgacaaaccaaggcagcagggcttctggtcacctggcctgaagagctcctgggcacacctgggataaaacccaggacctgcaaagcctgtgtgatccagcccaggccacgatgtctgcacccctcgctcactctggcattcttgctgttcttcaaacccgccaagcccagcactgcctcggggcctttgcaacaggattccctctgcctgagggacctacttcctctacaggctcctccatcctccttctgagacgactccatctaagaacaccttcctcttccgcctctgttagttttttccataacacttgtaacttttggagattacatgtatgtttgttttctagtttatgtttttccactggacagggagctccttgaggaccttgtcttgctcgctgcccccaccctaaaacttgctgtaaagcagttcctggaacagagcaggtgctcagtagtactggttgcatgaatgaatgaatgaatgaataggttttcctcttttagacacattgggagatgggcctatggtttcctatgctcattttgacccagagatttgtgtcctgtgactcacatccagacccaaaacacacacatacacacgcacacataaatacacacacacacagacacgtgcacacacagacacacatgcacacacacatacacacaccttggtttgaagagaagagggatgggaacagacattctacgcatgcctacagtgcaccactgtgcataggtaactgatgctgtataagcactcaaggattatctccatttttagccagagaaactgaggcttgctttctgctgtgtctccagtgcctagcactgtgcctggcataaacatctgctgaactgaattgcactagattcaagaggctcagaaaacagttcaaggtcacccaactagcaagttgtggagccagaatctgtgctcagggctgttcagtccccagccagtgccgggtagcagccataggcacctgcacaaactccagcgacctcgttaacttccaaacacggtctcgagggcaggccctcacccagacacccaccaactggcagctcagatgcaaatctatcctgcatctgaggctgctctcaacatgcccaggggcctcggcttcagcaaaccttgctccctgggctagctgatgccttttcctgccccagctaccctgatcccagccccagtcccacacttcctggccactgtcaaaaagaggagacactagtgacgaatataatgtcctatgaatgccttctgatgccaaatgtcatttgtaaaaattagccagttttgagttatctgtgtcagttcctctttccaatgcagctcattaggaagactccatggaattatcctgcgtcagaaagagtttgagtgatgattcaaaactgcagccagcaaactttcgctggaaagagtcaggtagggcggggtgtgatggttcacacctgtaatcccagcactttgggagtccaaggcaggtggatcacttgaggtcaggagttcaagaccagcctggccaacgtggcaaaatcccatttctaccaaaaaattaaaaaaaaaaaaattagccaggtgaggtggtgggtgcctgtcccagctacttgggaggctgatgtaggagaatcacttgaacctggaaggcagagcttgcagtgagctgagattgtgccactgcactccagcctgggcgacagagtaagaccctgtctcaaaaaacaaacaaacaaaagaagtcagatagtaaatactttgggttttgcaggacaagaagcaaaattgaggatgttacgtaggggctttcaaataatttcacatgtcaaaaagtgttcttcttcttcttcttcttcttctttttttccatcattctcagcttataagctgtgcagaactgacagcaggctagttcggcccacgacctatggtttgctaggccctaatttaaagcaactttttaaactttgatgttataaaaattgcctgatacacttgtgaaagcagtgtttggacacacactcagagattctgatgagaaggtctgggtgggccactgaatttgcatttctaactggtggatcaatggtgctgatgctgcccgtccaccgtccacattttgagcagtactgatattctaaagtgtcccttttcacagatgaggaaactggcttagctaagtgatatgtccatgtacaccctgtggactaggtaatgacatctgctctgccactccacagggctgttttgccacagaaaactcctctctgattctttaacccactgctaccctcatgcttctgagcctttgtcttcactcttctctctgccccatgcccaccctcacaaacgtaactgtcctgtcgagaccaagctcaggcgtcagctccatttaaagtatttcctgacctcctcaaatctaaattctcctttctgcaacagtatctgtacatacttgtgtataatgtgtataactgtttgtctgcatgcctatctttgtttttcgatttttcgttttgtaaaaatggggatcttgctagattgcccaggctggtgttgaactcctggcctcaagtgatcctcccaccacagcttcccaaagtgctgagattacaggcgtgagccacggagtccaagaattgcttgagcccaggagtttgagaccagcctgggccacatagtaagaccccatctctacaaaaaaagaaaaaacaattaattagctaggcttggtggcatgtgccttgtagttccagctactcaggaggccaagatgggaggattgcttgagcccaggagttcaaggttgcagtgagctgtgattgtgccaccgcacttcagcctgagcaacaaagcaagacctatctttaaaaaatttaaaaaaggaaacacaaaaggaatgtaggcccggcacagtgtcccacacctgtaatcccagcaatttgggaggccgagacaggcagattgcttgagctccgaagtttgagaccagtctgggcaatatggaaaagccctgtctctacaaaaaaaaaaataataatacaaaaattagccaggcatggtggtgcacacctgtagtcccaattactagggaagctgaggttggtggaccacttgatcctgggagatcaaggctgcaaagagccgagatcatgccacaacactccagcctgggcaacagaacgagaacttgtcttggaaaaaaaaaaaaagaatccatggatggatcatagatggatggatggatggatggatggatggatggatggaaagatggatgggtggatgggcaggtagatgtatgaatggctggatgggtagatgaatggttgggtggaagcatgaatgcgtgggtgggtagatggatggatgggcaggcaggtgggtggatggatgaatggatggatggacgggtgggtggattggtgtgtggatagatgatgagtggatagttggatgggtggatggatggatgggtgggtggatgaatactcctcatgatctattgcttgaaaataattttcatggcaaagttaagactagaccctaattctgctagagtatattccatggctgtttatgttggggcataccgaacatgctaatggtagtagttatattttattgtgtgttgagtgtgcacttacatggcaggctttgtactaagcactgccactaatcctctcaataacccctttattagctccatctttactacaagaaaatggaagctcagaaaggtagagcagcttgcccaaaaccacacagcaaatcacttcctagcccatctgattctgtgccaattgccggtcgcctttcccaccctccaccagggtttctcaccctccctggctccaccccacctctgcgggcccccagctggcctcacctccatcagcataggtctcggtgccatagccgtcttgcaggccattgttccaggtgccctcatacttggcaccgctgcttgagctctgccggattccgtagcgtcccttgaagccatgtgtccactcgcccttgtagagccagcgccccttggtctctatgcccagcccatgccgtttgccctggctccagtatccctcaaaggtgtttccgctgggccaggtgtagacacctgccacctcaaagccaaagttccaggagccagagtattcgccctggcccttggggcctgtgcacagtccatgcccatgggcctttcccccctcccagcccccgcagtacgcccctccatcatcaaagtcgaagcggcccccactcatctcatcatagcccctgacaacctccccgtcctccagcgtgggtgcagagggcgtgggtgatgcctgcaacactcctccagtgccctcgggggcaggcccccagactcaccactgcaccccaggaggggggaagcaggatgccagcagaggctgaaagagccccggcgccaagtcagcaccgggtcggctagtcagtgccatgcccgggagccccgactccaccagccagagcaaggctgcctgctggaaagaaagcaggaaggaaaggttcaaagtccccacaaagcgtcccaagtctgccttccaagaagtccaagggaaaacggtgtgatctctttaagaagcccagtgaaagggtggggtggaggggtccccagccttttcaaagaggggaaattcccctcggtggcagcccccgccggaggctgaattcccgcagcccgctggcccccttctccaccccagtgggtgtgcggggctgtcggtctccccgccgctgccccgcccccttctccaatcctgccctccttctgggacggaaaggtcagtgttgccctaacaaggccattggatctcagaagctgctcccaaaataacccccagccagcccagccttcttcaaagcgggaaggaggggtatttcaaatcgcgcccgtgccgcagacccgggcagtggctggaggcatgaggaaggaggctgagaactgagtgcaggcagcccagggaacctggtgtcttttcctcccgggaatgagagctcccttccattctcagagtcccctgggtctgcgcgcagggagggcaccggggaatcggggaagggaggggagagggagaccagcagaacacccagtcctggaacactgaaaatcccccagagcgaggaggttggcagatctcagccccatcaccactcacatgccctaaggggacctggggttacagcaccactgccagccccatcaaggaatccagtgacctaaagagaaaggaatggagacagtttcacatgtgcttccgaaagcagaggagggaagtcagaaagagaggggaggctgtggaaacagggtctggaagatacacagaatctcagtccagtgctcactcaccaccctgagctccctccacccctggaagccggggagaacttggtgcaagaagcaaccatctattccctttctctttctcctgaagggcaaagagaagggagaggagcctgccctcctctctgcctgagacacagactgggcgtcccgctagcttcctctccccaccccttgatgcctcggcgccctccctgccccctgccgcagacccagcagaccctgaaggtcaaaggagtccccttcctgtcaacacagggttgtgttgtaatgaggtcctctcagaaattctcaagggtcatgattttttaaaatttccctttctgagctgtcttttgctctagtgtcctaggagcctgtgaggccagacttcagaaagctcttggggcagggccaggagagaagggcctgggtggattcccagccactcaggttcccaccaaactccagtaaaaagaacaaataaatctccatggcaagaagctgtggccagagctaatgattgtaaatcccagctaagcccaaggttaatgggagtatagaggaattctgggaaaggtaagagccaccaagactaggaagatctgtgtgtgtgtgtgtctgtgcgtgtgtgtgaacgtgtgtctgtgagagtgtgagagagtgtgtgtgagtgtatgtgagtgtgtgtggtaagagtgtgtgtgtttgtgtgtgtgtggtaagtgtgtgtttgtgtgagtgtgtgtggtaagagtgtgtgtgtttgtatgtgtgtgtggtaagagtgtgtgtgtttccatgtgtgagtgtgtgtgtgtgagtgtgtgtgtgaagatggggacagaagagaaagagagaactaagcacagaaggtactagagaacattagacaattatctgactttgaacttatctgacatatttccaaaccccatgataacttaggccacgtgaagtcactgcggaagtcttgttcctgtttggggagtgggtaaaaagtgttccctgctttccttccagtgggttacctgttcttaggacttggttccatccttggtcacagccgctgaccttcaagagccccttctatatctgcgtttcaccaccaggtagaggcacccagcctcttgggctcactgtcaccgtctgtttgccaagctgacagggagcacgtagtggataaaaactgtttcctctgggtggttaggtgtgagccctggccaggctgactgacagcctgcttgcacaattcacttctaagaacatctcagggctactcccagggagttctgctttcgccacttctcactaggtctttggagaatcacaaacttctttctagctctgctgtcaagggaagagcatctcaaactggaagctaggggagtttgagctgcagattcaataccgtaatcatatgtttatgccaggcagccattgctacatcttagcagggtgttctacctatgggaatttaaccactgttcatccatagcagctccctagggtagctgtctacccagggttactacacataagaatcacttacagacttaaaaacataaagagatccgagagccccacccgagacctacagaattagattgtcctgggagaagacttgggcagtcgaattcttttaaaagctcctcagatgaatctgattttcatctctggttaaaaacactgtaagtgcttgttatagtggctcacacctgtaatcccagcactttgggaggccaaggctggaggattgcttgagcccaggtgtttgagaccagcctggacaacacagtgagaccccgcctctacaattaaaaatttttttttttaattagccaggtgtggtgatacacatctgtggtcccagctacatgggaagttgaggcaaggaggatcgctgagtcaaggagttggaggctgcaatgagccatatttgtgccactgcactccagcctggcaaccctgtttcaaaaaataaataaatagatagaaaacaacaacaacaacaaaaccaaggtaaaatttcaaattaagatactgtttaataacataaaaattcatgaatccatttattcatgaatccagtagttttggagttagatatgtcttcaaatcccagtcctgcccctcacaagctgtgtgaccttggaccaattgttaatttctctaaactgcaaattattcatctgtaaaagtccctacctcagaggattattggtatcaagaataacagtatctaccttatctaactgggtgaggattacacagttaatactgtaaaaaggctcagaacacattacacatataatcagtgttagctcttatgagagttactcttacatactaaattacttttcaggcttaataaaatagtcctcaaagagggaagagagaacccctcctaaatattaaatatcttgacatcgaagcactccttattctcatgttttaaactgcaaaacgaagttactggtaaagggatactttgactttgtaaaagtttaagtaagattctttgccaaatttggtactggccttacctgcccagagctttctgacaagctaccatttgtcccgccttttaaaccagtgcatttcagggaaagggagacctcttgtggcgttatgtgcattacaacggactttcctcagaaaaaccaagttcttcaaatccagtggaatttactaaacttgaaatattagccgggcatggtggtgcatgcctgtggtcccagctactcagaaggctgaggcaggaggatcgcttaaggctgggagatcgaggctgcagggagccatgatcacaccactgcactccagcctgagtgatggagcaagatcctctctcaaaaaaataaataaataaataaataaataataatttaaaaataaataggccgggcacggtggctcacgcctgtaatcctagcactttgagaggccaaggtaggcggactatctgaggtcaggggttcgagaccagcctggccaacatggcgaaaccctgtctctactaaaaatacaaaaattagacgggtgtggtggcacctgcctgtaatcccagctactgggggcgctgaggcaggagaatcacttgaacccaggaggcagaggttgcagtgagccgagattgtgccactgcactccagcctgggcgagagtgagactccatctcaaaaataaataaataaaaataaaaaataaaataaacttgaaataattataaactggttttaacggtagctagcctattccctctcttcatctcagatctcttcccactccctagttctgttccctggtcactttctccctctatttcctgctcaacttctcaagcttgactgcttctctgggaacctcaaagggagagaactggaaatccggaacaaggagaaggactgcacccagaaatccactggagttcttcttagccatggaaggctcagcagagcgagcctcaccgtccaggaagcctttccaggcaggtgtcctggctgagctagtgcccttcccacatgctgtctcctcccccaaactatgagttgtttaaagcaaggattttcttctttccaaaaaacagtggatagtgctgcagtgaacataggtgtgcatgtatctttataatagaatgatttatattcccaaaggaatataaatatatattccttgggcactgccaagtgcccaagccaccaaacccattcccaaaggaatataaatcagtaatgcgactgctgggtcaaatggtatttctggttctaggtctttgaggaatcgccataatatcttccacaagggttgaagtaacttacattcccaccaaaagtataaaagcatccctatttctccacagccttaccagcatcttttgtttcttgactttttaataattgccattttgaccggtatgaggtggtttctcattctggttttgatttgcatttctctaatgatcagtgaatcaacccaaatgtccatcaatgatagactgggtaaagaaaatgtggtacatatataccatggaatactacgcagccataaaaaggaatgagatcatgtcctttgcaggggcacggatggagctggaagccattattctcagcaaactaacacaggaacagaaaaccaaacacgttctcacttataagtgggagcggaacaatggaaacacatggacacagacaggggaacaatggggcctgtgggtagggtgggggaacaggaagagagagagcaccaggataaatcgctaatgcatatggggcttaacaggcttaatacctaggtgatgggctgacaggtgcagcaaaccaccacggcacgtgcttacctatgtaacaaacctgcatgccctgaacatgtacctcagaacttaaattattaaaaaacctgagcacctgctgtacagtagatattgcagctcacctgtgtctacccagtgcctgcacatagtggctgctcctggtcttcccagcatctagcagctgatgacccccttctgaaatcctttttcaactggcttctagaatctctctcggttctgctcctgccttactggttcctcctcatccccctgagttctgtaccttgggaatgtcccaaaccttcgttctctggcttctttatctacattcatttctgaggaggtctctagtcacatggctttgcataacctccctctaccgatgacttcgaagtctgcatccccaggttgcaccactctcctgatcttcagtcagacatccagccacctactcaacatttctaaatatctcacgagcatctcagatttgacaagaacaaatgaaactctcaatttccacttgcaaatttgtccctccagccgactccaaacttattaaaacctttggagtcaaccttaattcctgtctttctctcacaccttaaatccagtccatcggcaaatccctgaagggatttagattaaaataattccagaacaggctgggcacggtggctcacacctgtaatcccaacactctgggaggcagaggcaggtggatcatgaggtcgggagttcgagaccagcctggccaacatggcgaaaccccatctctactaaaaatacaaaaattagccaggcatggtggcatgcacctgtagtcccagttactcaggaggctgaggcaggagaattgcttgaacagggaggtggagactgcaatgagctgagatcgcgccactgcactccagcctgagcaacagagcgagactctgtctaaaaaaaaaaacaaaaacaaaaacaaaaacaaaaaaaaccttccagaacacatattatctcctgcactgccaagtgcccaagccaccaaacccattgcctgactcactgaagtagcttcctaactgtcctccttgccttcccttagtctgcacatagtagccagtgctctttcaaaaggttaagtctcggctgggcatggtggctcatgcctgtaatcccagcacttttggagggcaaggtgggcagactgcctgaggtcaggagtttgagaccagactggccaaagtggcaaaactctgtccctactaaacatacaaaaaaattagccagacatggtggtgcacacctgtgatcccagctacctgggaggctgagacacaaaaattgcttgaacccgggaggtggaggttgcactgagctgagatcgtgccactgcactccagcctgggtgacagagcaagactctgtctcaaaaaaaaaaaaaagttaagtctggtcatgtctctctcctctgcttccccaaatgactccctatctctcacagtaagagccaaagagccaacacctttaaaatagcctaccaggccctccatgatctggccctactcatctctctctgaccccacctgctcaagttgcattgacatccctgtggttccttctgccaagaatgcccctccctcagatgcccccatggctcactctcttacttccttcaggtctctgctcaaatgtcaccttatcacagcatcttctctgcccaccccaaatagcaaccctatccctggcccaccccttcctatctcctaattctttttctctccatacaacttacatgttcatcacctctctctactgaggacaaggatattgttctgcttactgttccattcccagaatctagtacagtgtccctggtgtgttgtaagcacttgatatttattgaatgaatgaatgaatgaatgaatgaatgaacgttcaatgaaaacttgttaaataaaggcatgtggaaatcaggatgttacttttttggaacatcagagtgagacttaatccctcaatccacaaaccaaatccattttcctagatgtatcagagaaaggagattagtttggtacatcacattcacaaaagaacgtcaaatatcccaatgagggaccctaatgttaaagttgggccaattaggtctgagcagagtaatttttaacttcaagattcatgttttgaggaagattttgctgagatgtagataacttacaacttattcccacaaatctggaatgcctaaactttcatgcaagttggattttgagttactaggtcattggaactttgtgcttttcaatacttacaccctcctaacaccttcatatgaaaagaatacgtatcatcattctctggtgactgctgcactaatatacagcactaagtaaataaccagagcgctggcttgaaaaacaaactaaaagggatttaaaggcttaagaactcgccttaattcaaagaacatgttaagcccatgttaagcccacttaacatgaacttgaatagctcactacttaattacaatagctccactcctctacagcttttattttatttttgagacggagtctcgctctgttgcccaggctggagtgcagtggcgcaatcttggctcactgcaagctccgcctcctgggttcacaccattctcctgcctcagcctctgagcagctgggactacaggcgccagccaccacgcccggctaattttttgtatttttagtagagacggggtttcaccgcgttagccaggatggtctcgatctcctgaccttgtgttccgcccgcctcggcctcccaaagtgctgggattaaaggcgtgagccaccgtgcccggcccagttttaatttttttaaaggtgagccaaaacattagttgtggaggtgaaagcggggtggtacctttacaaccagaagcttaaattttggtcctggaatccctgaggcccttttaggaaatctgaggtcaaaattatttacatggtactaaaacattacaggttgagggtccctaatctgaaatgcttcaaaatccagaactttttgagcactgacatgaggagcaaaggacatgctcattggagcagtttggcttttaggattatggaagctgaactgataagcatgtaatgcaaatctttcaaaatctaaaaaaaatctgagatccgaaacacttctggtcccaagcatttcatataaggaatattcaacctgtagttgcctttttcacattcattctcccaagtgtacaaaagtttgccagagaccacacaatatgcgatatcccagagactgaatgcagaaacatatgagaatctgtcttctaattaagccaaacattaaaaaagatttgcaaaaaggtagaacaatgccactcttctattttttgttttggaaaagctatttttcattcaaaaattttgttagcttgtaatgagtttttaaatatttaaaaaaatcttagttttaatttctaacatggtaaatatttatatccttttggagattataacaaaaccttttgggtcctgaatttgtcagtgtaaaggaagtgcttacaaaaagtttgagaatttctgccttagatatactaaatagtgtaccttctgtcaccattatcaggaaatatctgtcacagcttctagaactgtgataaggtattttgctcccttgctttaaccacagccttcagatgtcactaaatccacaccaaaccaatgaccagcagaggactcccactactacttaagcttagggtttttctagtaaacacccttcccctctcccccaagtacaaatcacctatttgttgaagcccacatcccattatcatgaatcaaccacagccagcgcagttttagtaaatagtataaatgtattttgtaatttaaacaaaagcttctgttaacattattgctaacatggctagacactgtcactaaatttggtggctctgctcaggatggtctgaacacatgcaacattctttttggagccacctgaaaaacaaggattcatcatccagctgaaaccgaagacagattttttttttaccaaactggagggaattttgaaatggctgaccaaatctgtgggatacagaatgtacaaaattctcttttagggttgctggggtgacagggcagctcaaagaggtaaccatctataacatctgaaactgaggtatgagacctgtattacaactgataacaaaaaaaaaaaaaaaaaaccgccatatatttaaaatgctggagatggtgaagacacacactcgtttcaaatattacaccccctccctccaactgaagcagcccattccaagctgcttacttgaaactgcatgtaacatgtcttaggatgaatagcaccagcaggggcttatttagtgatggttaataactctctcaaacaatagagggcaggccagctagtttattcaaattgaatctaaaccttagatctctggcttaacaataacaagagaaacctttatagacacaatatatcttgcattaaatcagagacggtttaaatcagtcttgtaacttctaatattctgggctggcaactacagcatgacaaatgtttagtgcagttacaaaatcacattttactttccttggctagcaaaccttaaacaaatctgaaaaatgcactgttttacaaaggcttttaccatatacccactgctgccagtctcaagtaattatggtttcttcatcccccaggaacatttctaaataagggggatttttctttgatctgctcgccttgaagtgtatgtaagaactcaagagagtaagttgaaagaatgaagattaactgagatgccaagaaaagtttttattgcaagcacagtgagcagaaagagatgtcttctcacacaaagtggccacaaggtctgccattaactaaatctctttgacaagccttcattggtttaaagcatatgaattagcttcttgctatcaggtgtacatcatttctgccatgtgggacattttcttgggaatatacaagtaatactccatgtagcctgacaggtcctcaatggtcacatcatccacgaagactcgagcttgctcagaacaggatcggggagagccagacagagttctggcgtgcagcgactgagagtagtcctcaagtgtggatcttcgttctggagccaagggagggacactctgcaggcctgaaaaggaatacacttccatatcatgccatctcttacactggcattccttgcctatgcatgtgcatggcttgccctggtttagcttggaaactgattgaaagtcagagagatcactggctttgagacttgcttgggggacttgggtagcgtcagaggagtcttccttcttactctctgatgggagccttggaacagaagttctcaaaggctcaacgactgcccctgtgtgattagcatcgagagaagtagagctttctcctgcactgaactctttaggggatgaaattcccagcccactgctgccatcaggtgagtcagtctggcttttgtgcttgagttgactgctggaagaagacgctattgtactgcaatgtataaactttggaggatgaaggacaggagacttagaacgtcgacgacgctgagttctcactgctcctcgtgaagacttccttgtagacctaaagaggaaaaaaaatatacaagaagatgttgggatatggagctgtcctaaacagattctttatgacagtaggaaatttaccttccctcagctttatgagtctaagctcataaatttcctgcaagagatgcaccttcctccattttcatgctgcctaagtctttgtgtctcaacaacttcaacatcatcttattagcaagctatagaacgaggtgagataatggtattttttaactgaatcacctgggccaaacatttgggacagaacacctgccctgttccaactctaagcttgggagcctttgaccagtgggtctgagggaagcacctcaaacatacaactgaaaccgatcctgtgaagcctaaatattgtgccctaaacctgaatatagcagcttcagaaccactgtgaggctaacgttacaaatgaccattatgccattactattaaatagatttctgattcatttctatcattggtaacagccaatcaatcaaaaccaaaaaactaacaatatttacaacccctgaggttttcagatactgggaattactggacacactatgtaagataactatttataaaatatttaaatagccaggcgcggtggctcacgcctgtaatcccagcactttgggaggccgaggcaggtggatcacgaggtcaggagattgagaccatcctggctaaagcggtgaaaccccgtctctactaaaaatacaaaaaattagccgggcgtggtggtgggcgcctgtagtcccagatacttgggaggctgaggcaggagaatggcgtgaatctgggaggcagagcttgcagtgagctgagatcacgccactgtactccagcctgggcaacagagcgagactccgtctcaaaaataaataaataaataaataaaataaaataaaattaaataaagaactgaatgaaaagaaaagatactcaaaactgctaagtgaattagagacaagaaccaaacaagacactaaaaagctaaacagaacacagtaatcccatcttatccatggtttcgctttctacagtttcagttacctgcagtcaaccatggtctgaaaatattaaataaaaaattccagaaataaacaattcataagttttacattgcgccccactgtgagtggcatgacaaaatcttgcaccatcctgctccgtcccacctgggatgtgaatcatcccttcgtccagggtatccacactgtatatgctacctacccattagtcatttagtagccatcttggttattagatcaactaccatggtactgcagtgcttgtgttcaagtaactcttattttacttaacaatggccccacagtataacagtagtgatgctagcagtttgggtataccaagaaaagccacgaagtgcttctgctgtggttagaatgtgtcacccaaaagttcatgtgttgtcaacttggtcccgaatgcatcagtgctgagacctttgggggtgattgggtcacaaaaggactctgccttcaagaatggattaatccatccacagattaatgaattaaagggttattgagggacagggatagttatcacaagaacggctctgttataaaagccggtttggctacttctcacgagcccccttgccacgtgatatccttccccatgttatgatgcagcaatgatacactcactagatgctggtgccatgctcttacacttcccagcctcccgaaatgtaagaaataagtctctttaaaaattacccagtctcaggtattcagttacagcaacagaaaatgaactaagacagctttctttaagtaaaaaggtgaaagttcttgacttaataaggaaaggaaaaaaataaatcgtatactgaggttgctaagatctacggtaagaacgaatctcctatgtgaaaaattgtgaagaaggaaaaacaaatttgtgatagacttgctgttgcacttcaaatgtgaaagttacagccacagtgcatgtaagtccttagttaagatggaaaaggcattaaatgtgtgggtggaagacatgaacaaaaacgtgctctgactgatggcaaatgggtttgatattgtctgcagtttcaggcgtccactggggttcttggaacatatcccctatggataagaggggacttgtacacacagctaaagaaagaatgactgacgggaaaataaatctgaattatttgtaacaggggccagcaaattacagcctgtgggtcagatctggctccctgcctgtttttgtacagcttgtggacactgctccagtgggctagcactgtgagccacagaccaggctaggggatcctcccctgtccctattctccctgcccgccttcctggccagtagacaagctgcaccactgtccagcgcccgcactagctaacatctacatgttgggtctctactgttggcaactgctgatcattgagaggcagaatctcagttcaagactccaaccaatgctgggatctctggaggagaaaagagcatgctgagatctgagcctcactgggacagaaagtagaactgaccctggcactacctgctacccacccattccacaaggttctcctttcaggctagtcactctatcctgcgactgtctcagcaactgaagacagaatgtgtccaccagccaggacggccaaccccaggcaaacagggtagagtaggagttttctctcttatttaagcacttattaatatccttgaatttttgcttcttggcctccaacggctaaaaaatttaccatacggtgctttacaaaaaaagtttgtcaacctctgacctaaaaggcagtacagagacaaggatttggaaaaaatgtaaaagttaagagagatgacagagtaagtctggaatttctgaagaaacgaatacagagaacagaggacaagtgatttttatagacataatgaccaagaaattttctgaattgataagagaatctatgaacacaggaaatacactggagcaggataaaaagaaatccacataagagacactctgtagcaaaactatagaatagcaaagacaacaggaagatcttaaaagcagccagagactagaaagattatttccaaattaataacaattggattgaaggtatgcttttcaataccaatgtaacgaaaccagaagacaatgaactgtacctaatttaagtgctaagagaaaataactgtcaatctagaaatataatgtcaactatatcaactctatctttcaaaaccaaggaagaaataaagacattttcagataaatgaaagcaaagtacagtcttctgtatccacggattctacacttgtggattcaaccagcagcagactgaaaataccccttccaccaagttccaaaaagcaaaccttgaatttgctgtgctctaagcactatgctgagtctgtgtgagtgaagtgctgtgtaagcattgtggtaggtattataagtactctagagatggtttaaagtatacaggagaatgagcataggttgtatgcaaacactataccattctgtctaacagacataagcatcctcagattttggtattgagaggggcgtgtgagtggggaggacctggaattgatcccccatggatacagatgattgttatttaccaataggacctgatggtatttaacatcgggggccctttcaaatgtatttatatggagttatacaatgcagaggtcctatttactaataataaaccttcactaaagaaactactttaggaaaaaagtaagtgattgtatatgggaggtctgaggtgaaagcatggtgaggaaagaagatataagcaaacagaaaaatctaaataaacactgtctgcttaaataataataaaacctagtctgtgagattaagtaacgactaaaatattgggcaactatatcatggaagtcaggagatcagaggaaagggtttctaaggagaagggctaaattaccattaatttttgtctttgttaaaagcatgcatggtaaaatcaaggctaacaactactgaaagaatagaaacaaagtgtgccatttccaaaccactagaggaaaagaacaaacaaaatccttgaaaacaattgtgtttaaacaattggaaaggaaaggaggagaggtaaggtgggaaaaaaatagaaaaaagcaggacaaataaagtaaaatgacagaatcacttctgaagataccaataatcaaataaatgtaaatgcactaaactcagcagttaaaaacaaactgatcacattgaataaaacagaaaaaaataaaacctagtcatatgctatttatatgaaacacagctaaaatacaagaacacagaacgcttgaaagactagtaggctgggtgtggtggctcacacctgtaatcctagcactttgggaagccgaggtgggtggatcacctgaggtcaggggtttgagaccagcttggccaacatgatgaaattctgtctctactaaaaatactaaaattacccgggcatggtggcgggcacctgcgtaaccccaggtacctgggaggccaaggcagaactgcttaaaccggggaggcggagggtgcagtgagctgagattgtgacactgcactccagtctgtgtgacagagcaagaacaagattccatcttaagaaaaaaaaaagaatagaaaaagacacacaagcgaaacactaactagaagaaaactttaagacaaaagccattatgagggattaagaatgtcactacataataaaagtttcaattcaccagaaagaaaacattctaaacctatgctatataaatccaacaaaataacctcaagatacataaagcaaaaacatagaatttaaagggaaaatagacaaatacacttccatggggtagatttcaacatacatctctattatttgtaagtcaagttgaccaaaaaattgaaaaaaaggttccaataacacatttaaaagcctgacttaatggacagagaacccaagaataattagagaagtcccaatcttctcaaacagacatagaatatttgtaaaaattgactatggaccaggccaaaaaaaagtctcagcaaattcagcaaaagaaggaataggtcctcatctaatcattgggtcttaggttctatatcataacctaactcttttctggacactcagaaaggaaaatccaatactattataatattggaataaaaatcatctcaataagaagctcttacccgtgccaactgtctttagatgcacatgtggttttaggtttggtatcatctgttgctgttctgactggtgctctgacacctgtgccttctccaacagacagagatgctacagacctgaagacaagaacaaagtttacagctacaaaaaactgtaaaatgaggagaacatattgttctcactagctcaaatacaacttttatcaatacatttttttttctagtttgggtttctcaaaaattgctcagcttttaatgtaaattttccttcaaaaccaaatctagagtatccctaaaagcccatggctgcaaaatcataagccaaagaatgactggtaagtgtacccagcagcaggatataaatagactttcaggctgtttccctggggcagatcaggccttatggccagagaatgctaatgacactgaccatttatcttatgcgggcaaaccagagtcatggaactaaacttagtttaggagactccatctaacttaacactgaatacattttcaaatattatgcaacttttagaaaaatattctaacttttgcaacaaatgaacttgaaatattactcagagttaaatccttgcggtttaaaattatacagataatatgggttcccagtaaagaacgtgaaaaaatctaaaagcaagaaaaacagaatcatccatacctcacaacccagagactaccaacatcaaacattggtggaaatccttccagacttttttcacacacacacacacacacacacacacacacacacacccctcctactatacatgctatggtgttgacaaaaattctttagaaagcgacattaatctactaaaatgaaaggatgttcaacaaaacataattgaaagtaaaaagtaactgggaataacctaaatatctaatagaaaaaaaatactgtatttctaaattatggcatatctatatggcaaaatgttgggaaattattagaaattaagtgtacaaagaacttttaatgatatgggggaatgcttataaggagaaagcagcatggttaaacacctatacatatattatgatctcaactatgtaaaataagtataggctatcatgaaccagtggtctagatgttaacagtggttacggtaaactgtgatttttacttctgtttttatcctgttttgtttttgtaaatttttctataataagcatgtattatgttacaatcagataaataggatattgttttgtaataaatatatagagatttgtcctaataagacaaataccactaaggaaaacctgttgaacaggatcatgctaaattcctggcaaggcctggttagtttatgagtcaatcctcagatatcccatttgtaaactggcaacaatataaaacaactagaatgtatgatacactactacacaagtcttattctgcttagtcatgctaatgactcaccccttctcttatttcattttctcaaatattctccttcccttcttataattttactcaaggcagaatatatgctacaaatataattttactcaaggcagaatacatgctacaaatatataattttttttcatttcagcttttactttagatacaggtggtacatacacaggattgttcatgggtatactggacccaggtagtgaacacagtaccctataggtaggttttccacccacattccgctcctgccctccccacgccagtagtcagcggtgtctattgttcccatgtccacgtgtgttcaatgtttagcccccacttctaagtgagaacatgcagcatgtggttttacaaatacataatttttgaccatatattttgaaaaatttttaaataatgttccaagtaatttttagggataccaaaatggcttaattttactttttttttttttgagacagggtctcgctctgttgcgcaggccggagtgcagtggcatgatctcagctcactccaacgtccagctcccgggctcaagtgatcctcctacctcagcctacagagcagctgggactacaggcacgcaccaccatgcctagctaattctttgtttttttgcagacgggtttcaccatgttgccgaggctggtctcaaactcctgagctcaagtgatgtgctcaccttggcctcccaaagtgctggaattacaagcatgagccatcatgcccggcctggctttattttacatttcaacttcttaaaacatcaggaaagaagtccgtgtatcaagagttacttatacaaaattacacactaagagatttgtatgtataattgtgggtacacattcctagtattttcctgatataaaaaaattattcctatataagaaatcacaaaggatacactgcagccacaatctggaactctctgcttctctgctttgcttctgtttcccaagacaatttatcaaagtactgatatgaactggcaagttgaccatattagaaaaccatcaggaggaaagatatgtttttgaagtaacatggaagcaaatatgagcacctataacatctactgtgcaaatctatcagcataaatcttctcatttgatagcccaaaaatagtactagcaataggcaggtggctgtaacaacaactaacatctagttttcactttgtgctaggtactgcatgcatttcttcctatcgccttcaaggtaccacataaaggatggttaagagcagaggttctgggccagacgcagtggctctcgcctgtaatcccagcactttgggaggccgaggtgggtggatcaccaggtcaggagatcaagaccatcctggctaacacagtgaaaccccgtctctactaaaaatacaaaaaatcagccaggtgtggttgtggccgcctgtagtcccagctactcgggaggctgaggcaggagaatggcgtgaacccgggaggcggagcttgcagtgagctgagattgcgccactgcactccagcctgggcgacagggccagaatccgtctcaaaaaaaaaaaaaaaaaaaaaaaagagcagaggttctggagacaggctatctaggttcaaatcctggctctgcaacgtcctaccaatgtgacttttagcaagtaatttaatttgtgtgagtctcatctgtaaactgaaatgacagtagtacccatgtcctaaggtgtagtgagaattaaataatgcgcacaaagtacttaacccagtgttgagggcacaggaagtgaataataaactttaatgatgatgattattacttgtgggtgttctactctgagcttccagtgtttagtttccatttatgaaaagaaattcttatatccattaaaaatgttgatttattttggcctgggagaaagaattggtgtgagaagagtcttacacagaacattttgcaaagggtgaaatactaacattcagagagcagctggtatgcaggtgctctaattagtttggccaaagggtccaaggttattgatctcagtgacagaaccctcctgaatagaggtttccatagtgatagactgagcaatcacagaccatgaaatctacaatgtcttcatagatttccactgagccaacccacttttagtgaaaaatactgtgattcccttgagatgtatgataaaatccctagtgggacaccgcttgataatctttgattaaaaagaagtgggggggaagccctcctcaaagtgaacgaaaccaaaacacccaacctgggagggcaaatgaactgctacttttcaaatttaaccaaagggttttctttttaaactaaaacaatactgtgcagaatctggaagaatgtcgcactattagcatttatatcttctttcaataatgagaaatattaaaagaggaagagctttttagggaaaagggactatttaaaataagtaaacaaataattccaaataatatattacatatttaattaccctgatgcatccactcttaattttttgaaagcagtctgtagactctcctcctctccatccttggcttcggatttcattgtgcaagtttttacactacttatcgatgttcctgtttacactaaaaaagaaaataaagtgagcaaagtaaaaacaggtgggatcaaaagtatacctgttaccattactgttagaaaaaaaaagcaaatttttatttcaaaaaggaagtttcagtgtagataactggagactataggttttatttcttaaagggaaacaaatgaaatgataccaaaaatggatatgtactatgacagaatataaactgttcacatacttgatgccaaaatcctattacacaattttggaaactagatgatctaaaatctatgtttcagtatacatactttttaacgggaatctccccagttggtctagaaacctatgaacaaaatgacatcagaaataaaagggaatagctaaaattatagcactctgattctttaaaatgacactgagtatttgtctggcctaaccctagttaagtataactttcatgacacatgatagcatttctctagagcagtcctgacccagacagctatgttcacaggaagacacgttttagagaacaagacgttaccactgtgaaagcagaattagaaatgcactctaccagtaaggttgatacttccatttgtgtttttcttcatagcctggaatagtgtaattaattgttaaacaagaaagaaaataaatgaactatacacttgcaaccccctaaaaacttcattgtgcacatgagtggaaaaagaaaagaaaacaaacaaacttctctttagcctaaagaaaggttgaaagtaaagaaaaaaaacagaaatgactattgtgtagacgcaccactaaatgatctcttaactagtttgattaatcaaagtcctccatattttccacctgatttttatatttaaacagagaaaggtagatgaagaaccaaccaaagcaacaagaaacacaacagagaagtctgttaataaacccttgaatctagtctccaaattattttttcactcagggttattagtaccaaattttgaatacaaattaagcaaaccagcatctatgaacatatcagagagaatcagaagaaaagtaccacaaaaaaaatagaaatagagaatatttgaagcaaaaggttcacttcacctctttatttctaagcctttacccgcccccccccgcccccacccctcttgggcattctcagagggagcagtgcctctccaacggcccttgggtcctctctgattcatatctgctcgtttctcaaggtggctccgaagttattgtgagacctctaatattccaaaggtcaaggtgtcataatgtttgatataaagtaaccattatattattgtagtaccagcgcaaaataaagaggcaaggaatcaggacttttcactttacttatttgcggaagttaaggtattttaggcagagctctctggggaacactgaaaacagtctcaaaagaattcagctactaaaaaaaaaaaaaaaaattcagccagcctgcacctcaacttcttaggacaaaaaaataatttagatacattctcgacgtatattttgctggtttatttaagtacataaacatgaagaaacattatccacacaatcccatgcttcactagtctctaattctcagtttagggtaggatcccccaaatacacaatcaattcctatatacctggggggagaggtgagcaatcacttatttcaatattttcaaagcttcacatcatctaaaagagtactattgcaggttgtaaacaaatccttcctgctggtagaactaaattgaagtttgacttacaatgttcctcaattaccttatgatccgttagtcaatgttcagctcttaccgagttcataaatcatctgagccaatctccccaacccgcagaccgccccccaagtcctctttagccctctctggaaatcagtcagcatttacgtacacatcacatttaagtatacactgctgaaccctacaggcagaaattcatttctttcacaaatatttacagaattcctaccacgtgcatggcactagaatgaatgctagggatagaagcccaaactccatttccgtaaggactagaatctcattcctgccctccaagagcttacaatgtaacactgtgctaagaggctctgaacctacatatgtaacttttaattataccatgctgacttaatagcatggcaggtgatcaccctagatgttaatacaaactttacattcctgttgacacactaaaagatctatcatctaaaaaccaaaacaggccagaattaaaatctggctacagactaaaacttcaggaatgaagttctgtctaaaccattttcagacttccagcatttttttactactcactttttttctcagttattttagccaagagcaaatgagcgttaggcataaccttaagagctagagaagagcatgtttgtaattataaaaggctcattatgctcctctgcatccccagatccccattcaaagaaagggctgtacaactaactccggacaacagatataattggcttgcctttcttcattaatattaaatttgtgggagacagtcttggcgttttcactgcagtgaactcgtgaagttgaacaatctccaaagagatgaaactttaaaaagcctattcgaagttaaagtcaaatcacaccaggcaatttaactttgcctcggattttccacaaccttacaaaaattacaaagttcttctaagttcctccatcaaaaggccaaattcctggttttttctttcaacaaaatggatgcgtcacaatcttatttacatcttgccgttttaaccaagacctccttgaatcccaagcctaggtctacacttccaggcccctgagaagacctaagaacgatcaagaagggatgcgcgggtaagcgttgtcatcacaacattaaagatttcgaaactcccagaccaccagaaagcgtagagtatggggaagaaaaccaaacccagcaactctaagaggcaaactagaccgggaggaaacaatcggcccccaggacaaaaagcacattcacacctctccgtgcaacccactcatccctttatactcgcagcgctgcagccaaagcacaaagttctttcttttcacccagagtctgtgcctgtcgcggttaaacatgaacggaggaaaattcctagtcagaacccagaggggtaggacggggcttggagtgtggggacaacgccaagcagggagctgtccaggggcactgcccgcccggggtctccagctgtgaagttgcgctcctcgggagattcctggggtcagaacgagaggctggagtcggagcgaggcacaagggatgcgggagaagaaaggagtggggccgaagaggtagccaaagagaatggggctccgaggcgagagagaaaggactggaaggggcaaagggcggccaaggagggcgaaaaggggaagctgccgctgggcgggagacggcggaggagcgagacggggcgggggaccgcgggaggacgggaaggcgggaaggggagagagcgtggagctcggagctccagcaggcacaggccgcggcagataagggggcgcggagaggcccaggcccggcccaggcaggaggcgtcgggagacgacgcgacccaaggcgggcgggcccggggaaaaccgcccgcggccagaccggcagtggaagctgagacgcagtgctgcggcccctccccgtcacgtcagggcacttacctcctcgcagctgggacgctccggtgatgcggggcagtcagttcagagcgtctctcccaaatctcggcacccgactgacccggatccaaaccagccaagggggcggcccgcgcctcgggagtcgcgttgcgcctgcgcactccggcatgcacccctccccctgcttatgctcctcccaccccagtgactcggcagcgcggcagccgacgactgcgcagacgcagggcggcggccgcgcctctccaacgccccgcacccgcccccctcagaagcacgtgcgccttacgtaatttcctgttattcttcggtttgcctcctcccagtggcgtggatttgctcccgacccgcttttggggcgtgcctgcttcctcctctctgttaggtgagtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagaggtattggacgtggccagggtcaatagtgtgaagccagaattagaattgaattgaaatgccttcggttttgatatctctgctgtttgtcttgaggcaactgcttttcctcctttgggcctctcagttttccatctagtaagtgaggaagttgaaccttatcggtgaatctcgtgttttcaggcgtagactcctttgagaatctggtgagaactgtagatcctcttgccaaagaaatgcacctacacaccaaattttgcaaaaagatttaggcagttcaccaaaggagatgaattttaggattctttacatttttctgattctgaatgttgctcagatggtaggcgggaaaaggtgatctgtgcaacagctgccacccgctccatcaccaggactggttctgctgatctagctgtgcctctcctcgcctgccaatctccagctccacgtctgcactgctcaaagcttcgtgagaacagatgattttgcgcaattgagttggatggcgttgattgtggcccacccctagagtgagggtttttccctgaaccaaaactggccccatccaccgtcattccccaataccttagttgtagtcaactagataggctgccgaagatggtttaactgtgtccagcttaactacagccaggctttggaatgcctggcctatgtctgtaaatgaaatctaacaatttattgtataacgttgttaaacatgaagcatgatgttggccctggataaaacattttaaattctcgtcgttcataccagaggctcagtaactgaccggttgaaagaaaactgttcattgtaacctaatgatgctagttagatagcattagattatgttagagatcagataacttgttctagctgcctttgtcctgtctcacagtgctagtaagtcaggatttaaactgcccttctcaacatctcttggacaagaaaaagcgggaaatatgatgtatttattttctcagaccttgccaagtgaaatgtatcaaaaccaaacatgtctttttaagctgccacttcaaaatataacttaagataaaatctcatatatccttgagaaggcctggcacggtagctcatgcctataatcccagcactttgggaggccgaggcgggtggatcacttgaggtcaggagtttgagaccagcctggccaacatggcgaaaccctttctctactaaaaatatgaaaaattggctgggcatggtggcgcatgcacctataatcccagctacccgggaggctgaggcaggagaatctctgaagccgggaggcggaggttgcagtgagccgagattgcgccactgcactccagcctgggccaacagagcaaaactgtctcaaaaaaaaaaaaaaaatctcatatatccttgaggggaaagaattgtctggatcgtgattgaattcccagggcttagcacacttcctggggattagtagatgctcaatacagttttggtgaattctcattttacctgctttccatccctaattatattaaataccaaaaactaaaaagttacagtatttcattttatgtaagcacatctccatcataaagagttagatgctttccaagaatgtgactcattactcggggagtacttggaaggtgggaacctcttgtgaatgctgaagcctgttaactcacacacctgacgtggcctgaagttttaagtcattatacataggactggctcacggtgtgatacatcatgacttggaaagagatagaaaagctacaaaatgggatggatctgagtgaacaaaaagccagatcggtgtcctataccagcaattccaagtctttttaaccatgggaaaaaaacctgaatttgtgtgtggactttatattgaagaaatcaactttgtattaatgcacatggtaatgccatttaattaaaaagctgtggtagatgtaaaattcctctaacagtgcttctttcttgctacaagtgtcttgtacatgctttagtaagagagacttaattccatgaatttatactgcaagaacaatttatataggaagataatagtttctcttaaaaaataactttggagaagccaagtccaaagtaataaagaaaattatttgcctaaccatgtggctgccatcctaccagttggtaatctggaaaatattctgttcttatgttttaagactcaaattaatttatttcttacctcgatatacttttttaaatgacttagggtaggccaggcgtggtggctcacgcctgtaatcccaacactttgggaggctgaggcaggtggatcacctgaagtcaagagttcgagaccagcctggctaacatggtgaaaccccatctctactgaaaaataaataaataaatatacaaaaattagctgggagtggtgggcacacacctgtaatcctagctacttggaggctgaggcatgagaagcccttgaacccaggaggtggaggttgcagtgagctgagatcatgccacggcactccagcctgggctacagagcaagaccttgtctcaaaaaaaaaaataaaattaaattaaaatgactttgggatagaagatagtgataatgattatttgtcttgatttacaagatgttagctcatgtaatcttcataaccaatttgtgaaatgtacttctatgatgtctgttttacagctgaggaaactaggctcagaatagttagataacttgtccaaggttacatagtttgtaagtggtagaacggggattccaatctaggcagtctgactatagcaccctgctgaccgctgagttacactgctttccttagcctccccaccttcacctcctgtatgtacccagctagaccagggatacctgctttcacctggaaaataccactgggtttgaggaaattggctgcccagggcctaggactgttccagccactctttctttgcatatatttgaacccagcaggcatatttccctctcaggtcttttgtatgtatttcccctcctggagcattgtttactcacagttcatcttgtcattcaaagtctctgctcatatcagctccccaggggggtcttccttggcttccccagcacccccttcactgtgtatccctttaccctgctttatcatagcacttgtcactacctgacaatgtatagttattttttggtcccctcactagaatagaagctacccgaggacagggactttgtgtcttttttttagtcactattttttttaatcaaagatgcacattttcccacaatttattaatagcggttagaaaatctgaatgtgtcttataatcgccagtgtgtcctggtttaattggtagtatttttttctttcttacttgttcctacagtaagtggtgagtctttaaaatgatggtgtcttagaattgatgaaaatacagtgtatccccaaggcctgaactctatgtggcacatagttggctctcaataattacttgttaaaggaaggcattgagtgttgtgtgccagaaactattgaaaccttttttttttttttgagatctcgctctgtcacccaggctggagtgaaatggcacaatcttggctcactgtaacctccgcccccaggttcgactgattctcgtgcctcagcctcctcagtagctgggattacaggtgagcaccaccatgctctgctaatttttgtatttttagtagcaatttatatcattccagcagactcttagaaagtagatggggagggtggggaatgtaagagagaccagttagaagacactcgaaataatctgagggaagaccagaatgggaaccatggctgaaggatggtgagaccagcagggctcggcagcctgctgagcagatgtctggcctgagccgtgccagtaggtggcccccttcactaaggaagggaatccaagaagactaggtttggggagtgtgagacggtttggttttgaacataaaagtttcaagtgcagatgaaaggaggaatcaggtcccaaaggctgcagcaagggacttatcctgaggtttctccttctgagaactgtaggagctatggaaagaaatgaccaaatttattttagaaagatgactggtttcagcgtgagccggcatggtgatccaggcctgagatgatggtgatcgaaggggcaggtggccctaagtatggagaacaagtgagccgattggaaagttgcgtagatcaggccttggggagagattgactacgaacaggatgggcagtgagagaaagctgacaatgatactttgctttccagtttgagcaactgaatggatattggtgcccatctcaattaaactctgttgaacccagctgacagtgagcagaggaagaacatttaaatggagaatcatagtaacagctaatactttcttttatttctttccttttcttttcttttttttgagacagagtcttgctctgttgcccaggctggggtgcagtggtgcaatcttggctcactgcaacctctgcttccctaattcaagtgattctcctgccttagtcacccacgtgtgccaccatgcctggctaatttttgtttgtttgtttgtttgtggagacagcgttttgccatgttggccaggctgctctcggactcctggcctcaagtgatctgcctgcctcagcctcccaaagtgctgggactgcaggcatgagctaccatgcccagcctatgagggctaatactttcatagctcttcctatgcatcagaagactcattttaattctcaccacaattctatgagattaccattatcacactcatcttccagatgaggaaactgaagcaaagagaagttaagtaactcaccaaggtcacacagctaacaagtggcagagctagaatttgaacctaggcagcttggtagagtctgtgctgtcactgcctctctgtgctgatatatctctaaattagttcagtttggacagagtgaacctgagagatccgtggggcagccgcgtggaggtgtctagcaggcatgcagatatatggttctgaagctcacatgggaggtggggactggaaataaagactgtggagtctgcatacaggtggccattgaagccacaggaaaggtcaggacccttaaggagagggtgggagataatcagaggaaagaaacaagggagccctggaaggcaaacacaagcattccagttgtgggaaggacatagtcctttctgcaaatgaatacactgcacctggcttatagatcttcagtcaacagatagtccatcccgcagaatttgtttggctctgggtaccctgacaaaatggagttcctggagccacagccctaaggacctgcctcaatggtggtgatcctccccactttcttctaccatgagagtccactgggggcctgttggcttctctgggcatctgttttttgcccctccctacaactgaagagcctccagctcctctgtctaccacccgtccacttcgtcagctcaggtcccctccctgtctctacgaccacagtaacatttcacctggagcttcttcaggtccctcctgaacttattttcagccctttacccgtacatttcttgtatctcctgctagattctaaatttctggagggcaagaaaaacctattatgttgactttccctccctcaactcctgctcccctgtgtgtgttaaatggcccgaccccgttgtcccatgggacttcgcatgcagtccaccagaataggagctgtacctaccacaggagccagtgagtccatcagtcagtcagtcatctcagcaaataattccagttgtctactggctttctggaaacatgactggggactgttgatgcctttgacagttgattcaagcagcaggacctttcacaacagcctcctgtttttgtggatggggaataggcaagggttgggaagcgggaattcgccgctctttcttgtcattctcttcatagcccccaagctactgtggtctattgttttgatagttgctttcccgaaatgttaacaggatggagagtaaaggaggtaaaggaggactctgatgcctcagccatgcgcctgtgtgccgattcccattaagcctgcaccaatttgatttccaagactccagtcaatcctcagagctccaggaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtggtaaggattggaagggagtgttgagaggggcttttggggtgctggtaatattgttctttgacccgatgttggttataggagtgtgtgctataatgtggtatatgtacatttttctgtgcgtataactaaacttcagttaaaagtttttaaaacttaaacatctctatgtataccacaaaataggtatcaggttagggtgagcggtttttttccctacaattcttaaccttatctgagtcacaagacagccctccctcccttcctccgagaaagccacagaccactggttaaggacttctcctgcagcagccgaatagagaaagtgagcaaaggacatgagcagacggttcacagcaaaagaaatacaaatagcacttaaacttatgaaaaaatgctcaatctcaatcttcaaagagaagtgcttataaaaagtatgcggagataccatttttaacctgtcagattggcagaaatcccaaagcttgacagcatgccctgtggatggggctggaggtgggggagtcgggagaataaatagcaggacttttaatacattaccagtgggattgtgaaattgacagccctgttgatttgggcaatatctaccaaaattacaagtctaagagtctaccctgtagatgacatttgtacctatatgtaataatttatgtaaaagatgatccattgcaacattggctgcaatagcaaaagatcagaaacaactgaagtgtatgtacaggactggtgcatccacaaagcaaaatactatataactgggaaaaagtttgaggaagctgtgtgtgcgctgaggaaagatctctaagatataggtgaaaaaaagcacgacgtacagctaagaatatatgtttgtattgcttctatcttcataaagaaaaactgataagctagacaagtaactaagaagtgtttcaggaagtggttgggggccagcaggaggggccgggcttctgagtgtataccttgtgttctgatttttgaatcatgtcagtgtataacctgtgcaaaacaaaacaaagtttagagttcctgctctaaagctgctgagctaagcctttaggaattcataaattattatatctgcccaattaaagaataggtgggtttggtttttcagtttgaactgagctgtgtcttggtgagagtcttcagcttactccacatttgaacacagttcaggaaagtgtattgcagtttcctggctcagcctaactctcaagaattctttctttaccctccatatgctcaaaaccaatcttgcccctcaagtgttgacactcagctagctatcatttttcaaagtatttcattttcagcttatgtattcatgagcatctaactctgcctgagggggagaagagaagttttcaccagaaaagtatatctgtgttttcagaaaccaatagatatgaaatcttgctctccatcccttatctttgcctgtctctatagccatcctttctcctttccctcctcctagctaaaaccaatcccagctctcctcccttctcaggaaactcactttcttctgtatatgcaaacacacatcatgtcttctgtcatagtaaaaccaaaaacaaaaaaagcaaaccccaaacccacaaagcccccttctacccaggttccccacagagctcctgtccttttctccctgttggagccttagccagtggctctacttcttcccctctccacccaccccccttctctctctctctgggtcggtctctctctgtctctctctctctctcagtggctgtacttcttcccctctccacccaccccccttctctctctgtgtgtgtgtgtgtgtgtgtgtgtgtgtgtctctgtgtctctgtctcaccaccctttcttcaatctactgcaaccagacttctatctcaccaaaacgttccttgccaaggtcatggataacctccttgttgctgaatacagtggccctagtctcattctcatgttgcttgagttttgagccctgcctgacgctgaacacagccgcctcctccactcgctctcctttcagtccctgtggccactgctcacaggggcaccctctcagcctcaccttttctatctcctctgcaggctcctcttttcttgccggtctgctgaccctcaggggccatgccttggctgtcttctcatctcacattcacttccaggatgatgccgggttggagaatatggaaaacaaatctgacttgctcgagtgaaaaaggaatccactagaagaatgtcagaaagctcactcaacaaaaggaaaagctaaacagctaggccttatcagcctgggagccagaccgagcccttcccaggtgccaggaatctctgagcattgcctcaggcgattcagttccacacatctttgttcctgatacatctctccgtacaagattcaaattcccaggaaagaaactgattggctttcatggcagggtcatatttgacccactcctactcacaggggcaaaaactgtaacttcctttgtattttttctttttcttttctttttttttttttgagatggcgtctcgctctgtcgcccaggctggagtgcagtggcacgatctcggctcactgtaacttccacctcccaggttcaagctatcctcctgcctcagcctcccgagtaaccgggaccgcaggcatgcgccaccattcctggctaatttttgcatttttagcagagacgggtgttttactatgttggccaggctggtctcgaaccctgacctcaagtgatctgcccgcctggacctcccaaagtgctaggattacaggcacgagccaccacacccagccctgtattttcatctaatctcattttcatctcaaacttccattctcccaacttgaggggatatttccttctcttctggtttacagcgctctgttttgcacagatattcagtgttcaggatcctcctctctcctgtgtgctcccatcctcccggcgtggcatctgggtataagggggcagtgggtaagctttatggctcagatgccattccctgcctgttgctggtcttcactcccacgtggtcgctcggaatttgtccccgggcattacggattatggtggaacctaccaaaatggggtgaacctgatttagttcctgagcagtacacggacctgcttagaaaattgcctgtctgtagccatgaggtcctcatgtgccacaaccctcgcagcttgtcacctggcctctctttgtccctcagtccacttagcacatcactgggacatgtggacacatctggattaccacctacatggcacccacaggtcaaggggacaacgggctgctgttaccacagcttcggtgccagcttagtgctgtcacgtggtcagtggggggcatctctccctgggctgtgcttgggaaagtgggatcctactgtcccccaaacctgtccagatgcttcttagtcctacataggagttttccttcgaggagggtagacacttgcacctgaactcttgtcctgctttttttttttccttggcagcaccagaaggcttttgccctgcttgctgtacaggaacttgtctgaaccttatactgtgtcatctccacactatggcctatagaaaatctctatcctctcatccccaggttgtcctcttgctctgtaaagggaatattttgaaagttaggaaaactgtttctgcctcaacgaagtcacattttaacactaatgtccacagactcaagaaatctaatttaaaacagagccaggcaatggctcccattgattcagtggctggagggagctgcaggctaactaggaattaggaattagccacaacagaagtgcatttggtttcatctcaagaaatatcctcctttacacctgtcttggcagatgtgcccactgcttgggtggcaggacactttgattgtctcaccaagactgtgtggaaaggggtggggtacttctccaaagggaaaagtgggctgctgtcacccataaaaggggtagagggaaagggcaggcagaaacagtaaatgtcttccatagcttcaggtcacatctgcctgctgctgataccacattcatatctgcagcccatgtgtctcctcgatgccacacctctgtgtccacagtcttcctattcagtcgcctatgtggatgtccctctgacacctggtgaaacatgatgtgtttctaattgagcaggttatctttccccctaagcctggtctcctggcctttccccagtcccttccagtttaattgaatcaaatcgaatgtgattcatctcctcccatccgtctggctcctgggttatttaatacccccccaaactttggaaatattttaatgtgttaatatattattttttaataaaaaataattttaacaaaagaaaaatatacctttatagaaaatttagaaaatataaagactcaggcaccttatcatttttatctcctggttagccctgggaggcaggtactattatttatccccattttacagatgaggaaactgaggctcagagaggaaaatagcttgctgctttcacacaggtcagaaggatctatgccggatttgagcccaggtctttctgattgcaagctgaaggcggtcttgtctttgggatactcagttgaggggcttggcctttgcctcagaagcattcgacttggcccctgtccttgaggatgtcccctggcagcatttggtaaaggtgttgcggagcgcctaggagccacactgcctctgagaagccctgcctcagatgcccacccctctgtgtggccttgggcacactgcccaagcccctgtgcccagtttactcctctgaaaaatggggatgatgatagtaatcgtaggacttcccttagagggctaggagaggatgaaatgactaatgtggtagaacactgcccggctcatagcatctgatatggcttagatatttgtcccctccaaatctcaggtcaaactgtgacccccagtgttggaggtggggcctgatgggaggtgtttgggtcatgggggtggatccctcaggaatggcatggtgccctcccatggtaatgagttcaccccaggcccatttgttagagcctggtacctcctgcctcctccctcttgcttccctctctggccgtgttatctgtgcaggccggctccgcttcacctcctgccatgagtggaagcagcctgagacactcactagaagccaggcagatgctggtgccatgcagaactgtgacccaagcaaacttcttttctgtatacattacccagtctcagctattcctttatagcatcgcaaaacagactaatatagcatccaacaacattagccactgctactattatcattagtattttaagtgtgtgcattttaattgctggtacactgtgtgaactggcttggatgtttgtcccctccaaatctcatgtcgaactgtaatctccagtgttggaggtggggcctggtgggaggtgtttggatcatgggggcatattcctcatgcttggcttagcgccatcctgtggtgatgagtgagctaatgggagatctgattgtttaaaggtgtgcggcacctcccctctctcttgttcctgctcttgctatgtgacacacaggctcccctttgccttccaccatgactgtaaattccctatggcctcaccagaagcagatgccagcaccccacttcctatacagcttgcagaaccaagaacaaattaaacttgttttctttataaagacagactcaggcatttatttgtatcagtgcacaaacagcctcatacactgggcatacgtgttatatcctgctttccttcaatttactattagcgtttttatgtcacaaactattcctcaaaacattattttaatgactgtataatagtccatcatttaaatatattcataacttattctgtagttaaccatccacccgtttctggacaattaggggtgtgtgtgggtgtttgttgtaataaaaaactctaaaccaaaaatccttgtctgattattttcttagaattttacacctggaactcctgggtgggaaggtataaaccgtttaaagtctccggcaacacactaataaattgcttcaaaggaaagttctcaaccgttactctcagcagtgtgtgtattagggccatcctcaccacaccctttcaggtagcgaggtgagctttttcaaagtccacctttgttgctatttctttacaaggcaggttttactacatgtccttgggttggtgggggttggtcccatgctcaaggtgcttctacctatgctgcctgttacaatgttcttaaattagctaacagtcccataaaccctgagtggacatattcaccctgtttcctgcctggtctgttctcctgcgggtggaaatataattttcagtgctggaaatttttttttttttttttgagacggagtcttgctgtgtcacccaaactggagtgcagtggcaccatctcggctcactgcaatccccgcctccagggttcaagcgagtctcctgcctcagcgccccgagtagctggaattacaagctcacaccaccacgtccagctaatcttttttgtattttttgtagagacagggtttcaccatattggccaggctggtatcaaactcctgacctcaagtgatccacccaccgtggcctctgaaagtgttgggattacaggtgtgagccaccgtgcctagccaattcactggtttctctgtttctctgtcgcccctgctttaagatgtttagcatgtggcctcgctccctggtgacagcacagtcccaaagcccagtaatatattttaaagaagtctattaaaggtacgagcttagctggactgacccattatctgaaatctgtgtgtggccttcccaacttacattgccaatacttgtgcctgtttcaacttgagattcctgttcggtgtactctccctttaagttaccctactgctggtatcctaacctcccagaaagagagctagagttttattttgttaaagtaaaatcagtattccccagtgctctgtattttacaaaatgcattcacacatgactgccttgatcctcagaatgattctgggagttactgtgtttatctccattttgcagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtatggagctcaagggaccccttaagttgggcttacttagtaactccaggggtgggcagaacaggactccaatgagggtttttttctttttcccttttttttcttttcctatctcttaacttttatctttattattttacaatgcccttgtaagatgaaacaagtgatgctgaaatatctttttcttttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataaaaaaataaaaagaatgtggtgtatgattttgttttctgtttctatgttaatccacttaggataatggcctccagctacatccacgttgttacaaaagacacgatttcattctcttatatggctgcctaatattccacggtgtatatgtaccatattttctttatcacatccactgttgatccacacctgggttgattccatgtctgtgctattgtgaatagcactgcagtgaacatgtgggtgcgtgtgtctttgtggtagaacgatttcttttcctttgagtataatatatccattaatgggatggggctgacatacttaaagtagaaacgaaaattgtcatgtgctcccccacgcccctccattctactctgcagagagacagctgcctgctgtttgtggtttagtacacctccttccaggctttaaataaactaaacccatgcatatttctctgtgtatactttttcagtacatgtacacgtgcacttgtttgtacagtttgttctttaaattttataaaaatgtcccctatactgcatcttgatttatcctcctcatgattttaagaccttgctacatcagagctacttttctattctagaaagaaagacatggccaggcgcggtggctcacacctgtaatcccagcactttgggaggccgaggcgggtggatcacctgaggtcaggagttcgagaccagcctggccaacatggtgaaatcccgtctctactaaaaatacaaaaattagccgggcatggtggcacgtgcctgtaatcccagctactcaggaggctgaggcaggagaatcacttgaatccgggaggcggaggttgcagtgagccaagatctcaccattgcattccagcctgggcaacaagagtgaaattccgtcttagaaaaaaaaaaaaaaaagacagacacagaaactcttttcaatgtctcttttcaatgtctgggcattttacaggtatgtatatttaatgtattatttaatttgggttattaccaatttttattattttatttatttatttatttatttagagacagagtctcactgtctcccaggctggagtgcagtggtgcgatctcgactcactgcaacttccgcctcctgggttcaagtgattctcctgcctcagcctcccgagtagctgggattacaggcatgcgccaccatacctggctaatttttgtatttttagtagagatgggttttcaacatgttggccaggctggtctcaaacccctgacttcaggtgatccacctgtttcagcctcccaaagtgctgggattacaggtgtgagccaccacacctggcctggttattaccaatgtttaaaatattaccaatggtgctgcattaaaatgcttgtcaaacaagtttgtcctcttgtaaatgtattttgaagtgaagttgctggtaacacagattgtaatatttgatgaacaggcagaattcctggattccactcccaccagtggtgtttggggcacccattggcctacggtagttctcagccagagatgcttcttcctctgaggttctgcccctgaggggacatttggcaatgcctggagatatttttggctgtcacaacttgggggatggtgacggagatgctactgatatctagtggacagaaggcagggatgctgcttgacaccttacaataaacaggagagtcccccacaacaaagagttatgtcaatagttccaaggatgagaaaccctggcctccaccaagattgccagtgggggacagtgtcattctttccaatcttgccaatctggtagtttgcaaaatgataatttattctataccttttcaggataatagagatatctttatttcttcctttatatattacttgaatttgatataatgaacatgtatgatttctataattcttttgaaaggccattaaggattttttatttatttatttatttttgagacggagtatccctctgttgctcatgctggggtgcaatggcgcaatctcggttcactgcaacatctacctcccgggttcaagcaactctcctgcctcagccttctgagtaactgggactacaggcacccaccaccacgaccggctaatttttgtatttttagtagagatggggtttcaccatgttggccaggctggtctcgaactcctgacctcgtgatccacccacctcagcctcccaaagtgctgggattacaggagtgagtcactgcactcggcgccatcaaggggtttttttaaaggtctctacctcttggaccattaactgttgactgatgttgcagtgtgttcctaagacttaattgtgtacgtgcctgtgtgtttttccttgatgaggtatagaaggaagtcctcagtgcgggccttgagaatccatccgtgcttcaggttccagtctcccatcctctggccatcagaattcctctattgctcttccaaaccattttcacctggttgacacccaggcccaggggccatctccaagaatcaccttggcccagagagactcgttaccactgagcagacctccaaaacaaaatgtaccttgcggctgaccctgggaaacccagcacatacaccatggactcatctgcccaggggcacatttcatgcccacgttcatttcccagctttgaaacctgagatctatttgcccagtgaaattccagggctgtcagagctgagccaagccccctggtgctgctgcggagctggagctggagctgctggcataggctctggtggggctcacattccctcctcatctccactatgtcccgtcagagtggaaatggagtggagcccagtctcacccactcccaccccccacccccccacccggcatggcaaggactcctggagcagtaccgcactccttccacttggtgcagagtcagccagagtcagcctggacgaagtgtccacggggaacttgttggtatcacttggatattcccaagaaaatttcccacgtggtagaagtagcgtagacttgcctgcagcccttgtgaatcgtgtggagtgggctcctccaatagccgacgttcagagtgggcagacagctcctggccctggtgccgggcacaggacttctgccagcagttctgtgtgtttgatctgcagcccagtgtggttttccagtaaagcaaaggtgtatgtggaggttgcgtggtctaacgtctccactctctagaatccacaccagtcatgtcaggggcatggagtgtccaagctgtgaggccatgaatgccggagacacctgagcattgctgacgtggagagatggcagtaatcgggaggggaggagaggacataaggagatgggcctgagttctcagcctgccctgctgcccatcctgggcagataaatcactggacctcttgggcctcagcttcctcattaactggttattggaagcattcaccctttttcaatctgaagtttcctcaaaaacactgccaattagagaaagctggctaaaatgaactagagatttaaagtagagtttagagtaagtccagctcctgtctcttattcaaaagtaaccaatgctcagaataggaaggaaaaaaaagaaatacagccaagcaaaaagtagctcctaaagaacacccatgattccacccacccaaaggccgtggcatcctggtggaagccttctagatacgtggttcttttccttttgttttattgaaatgtagtctcactctgtcacctaggctggagtgctgtggtgaaatctgggctcactacaaccgccgcctctcctgttcaagcaattctcctgcctcagcctcctgggtagctgggattacaggagcccccgaccatatccggctaattttttgtatttttagtagaaatggagtgtcaccatgttggccaggttggtctcgaactcctgacctcaagtgatctgccggcctcggcctcccaaggtgctggaattacaggcgtgagtcacaacacttggtcaatatgtgattcttaacccggattagtagcctgcttttggggaagggagcccctgaattcactaaagttgtgtgtttgggttcaagtttctacctctcattcaattcacagagaggttcttgactcattgaaacaagaaccagtgttttaagtattttctttgcatacatatcaaaaatacctttaatgagatctgaccacacaggctattttgcaatttgctgttgtcccttactaatatactgagcttaatttaacaaaccgtcttttgtgggccctttaggatattctagttgtgttgctgttacaacgagtgcagtgcacatataagttgggtgaagaagaattagagcataaagagaaatcaaggaaaaaaaaaccataaaatttgaacagctgacaaaagtgctcaaaagggcacgaaaggatgtcaaattatcctacagtgataaaaattatcaataagaaacacgcaaggggccgggtgcagtggctcatgcctgtaatcccagcacttcgggaggctgaggtgggcggatcacctgaagtcaggagttcgagaccagcctggccaacacggtgaaaccctgtctctattaaaaatataaaaatgtggcaggtgtggcggacgcctgtaatcccagctactggggaggctatggcaggagagttgcttgaacctaggaggcaaaggttacagtgagccgagatcccggcattgcactccagcctgggtgacaagagagaaactctgtctcaaaaaaaaaaaaaaaaaacacaaggggccgggagtggtggctcacgcctgtaatcccagcactttgggaggctgaggcaggcagatcacttgaggtcaggagttcgagaccagcctggccaacatggtgaaaccctgtctctactaaaaatacaaaaagtcaggtatggtggcatgcacctgtagtcccagctacttgggaggttgaggcgggagaatcacttgaacccaggaggcagaggttgcagtcaactgagatcacgccgctgcactccagcccgggcaacagaatgagactgtctcaaaataaaaacaaacaagggactaatattttcaaccaattatattgaagtcaacaaatatttattgggcagatgctatgaatattatctgccggaccctctgccaggtgctgcagactcaacaggtagccgccactgaccttactgagcttacaaactagcagagaccaacatggaagttatttcacactcagacagtttgtgtttaaccaaactgccttcatgccccatgaccttggccacagctctctcattatggaaactgtcaggaggtctgggcataggcgcggtttgatgaatcaacgttggcagggagagacacagaggaatcctgaatcatctcgctccccatgctcttctcgcgccatgacccggcctccctgcctttggggaggctgcatgttccagccctgagtggaggccccctccaagctcacacccaacccacaggttctccctgaaagaaggtcattcaacccctgcatgttcttttcagaaacaggatgttcactgccctctgcctcagccccttcctgcttgtttgaaccttttccttatattgaactgcaacagcgctccctataacttcctctgattggtcccagaacctcacagaacaagtctgtcattttctccaacctgcagatctaaagacctttagatcttccttgggtgaagcatgcaatcccatagtctgctccttgagtggatgccgagggtctgtgatgcccttccctggcaggaagggcctgcaaacccctgctgattcaccaaactgcacatgcccagaccttctgacagggtattcatgagcagatggccacagcagggggcagcaagggccagacacttgggggccagctatgctgatgacactgaaaaaactttcgcagcttcaagagctgggtggggaaggacgagaagatgggccagccctgattggaggacctaatcggctgtcctcccaaaaggagcctgtgtgccttacagcagagcttctcacaattaaagtgcatgccaatctcctggaagtctgctaaactgtgggcttagggtagggcctgagactctgcatttcttacaagctcccagtgctgtgctgatgctttagactatgctttgagtagcaagaccctggggcagaggggaggatcacagtcctctatgagagctttaaaaatagggaaagcggctgggcacggtgggtcatgcctataatcccagcactttgggaggctgaggcgggcaaatgacctgaggtcaggagttcaagactagcctggccaacacggtgaaaccctatctctactaaaaatacaaaaattagctgggcgtggtggtgggtgcctgtagtcccatctacatgggagcctgagagaggagaatcgcttgaacccaggaggcagaggttgcagagaaccaagatcatgccactgcactccagcctggcgacacagcaagactctgtctcaaaaataagtaaataggctgggcgcctaattatttatttatatttatatattttttatatttatattttttaaataaatttatttttataaatttattttataaataaataggctgtgcacctatttatttttatttatatatattttttatttatattttatttatatttatatttatatttattatttatttattttattacaggctctcgcctgtagtcccaacactttgggaagccaaggcgggtggatcacttgaggtcaggagtttgagaccaacctggctaacatggtgaaaccctgtctctactaaaaatacaaaaattaactggttgttgtggcaggcataagcccagctactcgggaaggctgaggcaggagaatcacttaaacccgagaggcagaggttgcagtgagctaagatcatgccactgcactccagtcttggcaacagagtgagactccatcttaaaaataaataataaataaataaataaataaataaatgtggattcccaggccataccataaaccaattaaatcagaatctctagggctggattcctggcattgctactttataaaaggccttagttagttctaatgtgcacacagggtaaaaaatcagtgattgacacccctccactccccgccaccttctctttcactgcttcagcttgaaatctctactgggtgagactgatgaccagcccagtttggtttggagcagaagcagtggttttcaggatcacctgggagctttataaaatgtccatgtcagggctcctgccccagaccaactgaatcagaattgctaggtgtcagggccaagagattcttgtttcacaaagctacccagatggtgctaaggttcagccaccagtgtagagcctaatataagaaccatctaggattaccacattcttccgctgaacattcagattcaaagtctggggtgaggaccaggaacctgtatgtttaacaagtgccataggtgattctcatgagatgcaaggttgagaaacacagatggaggaaagatccctggattggagtcagtaagacagggctcctggctgtgtgacttctcacaggtcacttaccctctctgagattcatgtcttcatctgtaaaatagagatgatgataataactgcgtgaggcagagatggatctctgcccccagagacctgtgttctcagtccataggacgcagtaggtgttggaaagaggctgccactcaccagggactgcatttcccagctccactttgcattgaggtggggcgaccacatgactgagttgtggccaatgaatgtgggcagaagtgaggaatgctgctgcccataaaacccccatgatccgccactctctctgcccatctgcccattggatatcaatgcctggggtagcttcaaagccccaagggaaagttgatagaactctttgttcctccccacaccgctgccaactggactttatatgagtgaaaaataaacgtccatgtgtttagctactgtgacttgtatctgttaaagtaatgagtgctatgttaccaaacatactgcctctgggagtgtggcaaaaattaaatgctctaatgcagaggttgcaaacagacaaggtgtgggcttggatccaccctgtagatatgttctgttatgcctgccccagtgttcttttttatataaatttatcaataaatttttatttttattttttatgagatggagtcttgctctgttgcccaggctggagtgcagtggcgccatcttggctcactgcaacctctgcctcccaggttaaagcgattctcctgcctcagcctcccaagtagctgggattacagccgcacagcaccatgcccagctaattttgtattaagagatggggcttcgtcatattggccaggcttgtctcgaactcctgacctcaggtgatccacctgccttggtctcccaaagtgctgggattacaggcgggagccactgcacccagtcgaatttattaatacatttttaaatgagcaaattcacacaaacctctggatttccaggttcgtgaaaacccagaatcgctggcacctgggtttgcattccagtggctggacgaggagcggctgtcctgttgagcggaacttgtgctccccagtttgccacagtctccaccacacagcattgctttatgcctggcttgcctcacattcatgacacttctcccatatgcctacagcttctcgagtcagtgaaccctgatgcaatagatgtagaagttacgcgttagctgttaagatttttcacagcaaaattcaagtgacttcttgctctcaggaaagccattcttgcccagaatttggaagcaaaatcttctgggtactccttacgggctgaaagatgttccccaccccgaccctacccatatctgtggccatttcagcatccgctacatggaggcagaggtaagagatgggacaagctcaactggatttgggggtcagatagacctgggtcccaacgccagctatgcttgcttcctagctggggatttggggccaggcatttcttgttttctttctttctctctctctttttttcttgctcacttttctctctctctttctttcttgctcacttttctctctctctctctatctctcgctctttcttttttttgagatgcagtttctctcttgtcacccaggctggagtgcgatggcacaatctcagctcactgcaacctctgcctcccaggttcaagcaattcttctgcctcagcctcccaagtagctgggattacaggcacccacaaccatgcccagctaatttttgtatttttagtagagacggggtttcaccatgttggtcaggctggcctcgacctcctgacctccggtgattcgcccgcctcggcctcccaaagtgctgggattacaggtgtgagccacagccctggtcagcatttactgttttctgagttgctgtttccatctgtcaaatgtggacattaatgccctttccatgagattttggtaacaggtctagctcagaaggacactcagacgatgtgaattcccttcccttttcctgcagtgtgaggaccaggattggcttgccctcagtggtcacggggaaatcaagcaatatctttttttttttcctaaacaactttgatttaaaaaattaaaaaaatatatggaataatgcatgtctacaataggtatattagtcagcttgggctgccataacaaaatatcacaccccaggtggcttacacatcagaaactaaatgaaagaagtagaccaaaaaaaaaaaaaaatcagaaactcattttctcatagttgtggaagctgcaagtccaagatcaaggtgccagcagggttggtttctgttgaggcctcccttgctgacttgcagacggcaaccgtctcactgtgtcctcacagggcctttcttctgtgagcactcctgtgtctcttcctcttagaagaacaagagtcttgttgaattagggctttgcccttatgacctaatctaacctttattgtgtcctcaaaggccctattttcatatataaccacattagggattacttcatcatatcaattttcggatgcacaattaagtccataacagaaggaaaatcagaaactccaattaagaaaaataaacaacaggccaggtgcagtggctcatgcctgtaatcccagcactttgggaggccaaggagggtgggtcatttgaggtcaggagttcaagaccagcctggccaacatggtgaaactctgtctctactaaaaatacaaaaattagccaggtgtggtgacacgtgcttgtaatcccagctacttgggagactgaggcaggagaattgcttgaacccaggaggtggaggttgcagtgagccgagattgtgccactgtactccaggctgggtgacagaataagactccattcaaaaaaaaaaaaagaaagaaaaataaacaacaacaaaaaagcccactcatgatctcttcttacccttgtctccaatctcaatataaccacatgactactattagacttttattgactgcccttctacaatttatatgtcttaaaaaattgaattgtacatacttttttggtaacccttttttttcctctttacattttaaagattgtaataacctaagctaaatagaatttttaaaacaccttacataatcaatacctgttcttaaaatttaaacgtatcatgaaatccttccttatatttagtggatataaattattccatggccaggcatgatgactcacacctataatctcaacaatttgggacacctagatgggcagattgcttgagctcaggagttcaagaccagcctgggcaacatgatgaaaccccatctctatgaaaagtacaaaagttagctgggcatggtggcacaagactgttgtcccagctactcaggaggctgaagtgggaggatcacctgagctcgtggaggtcgaggctgtagtgagccatgattgcatcactgcactccagcctgggcaacagagtgagaccctgtctcaatcaatcaattcatccaaccatgttatagatatactctaatttttaaatcaaatcccctattgtctggacacttcaaagtccattttctatggacttagtgttcattagctcttgactttaggctactaatattcatatccagatgagtgtcagtttcccgatgtatattataaggatgataacaatatctatctcaattacaataacgtctataaagtgcttagcacactgtctgacacatggaaaccctcatgactgttattatgattattataaatctgtagaaccttgtatacctagccaatggtttctatatgataaattcgtaaaaggtaagtatatttgacagatttttgttaaatttcaccaaattttcttcctgagaggctaggcaaatccacaatctgttatctggaatgaatttttgaatttggcttttgtgagattttagaaaggtaatgtagtactatactatatattatgtgaaattcccagtgggggctggggcagcacctcataatcaaatacattaatgtttctttagagagagataaataaagatcatagtctcatatcagttcagtgcagatgttgtcactaaatgagtttgtctttttttttttttttttttttttttgagacggagtctcgctctgtcgcccaggctggagtgcagtggcgcgatctcggctcactgcaagctccgcctcccgggttcacgccattctcctgcctcagcctcccgcgcagctgggactacaggcgcccgccaccacgcccggctaatttttttgtgttttttagtagatacggggtttcactgtgttagccaggatggtctcgatctcctgacctcgtgatccgcccgccttggcctcccaaagtgctgggattacaggcgtgagccaccacgcccggccatgagcttgtcttaaacttgtaacttgtagttgggatagagagagaaaacttttgattttataacgttggactttaaaattgcagtcagggaattattgactttcataattggcaagtttagtaggctggagcggtagggttacttaagatagcaactcagttatttcatccagaggccatttgcttccacctcagtaccctgtcacttggtgtccgcttcattcaagtctggttcccctcaagaatggctgccgggaacagtggaggctacaggcttcctggctgatgtctagcagccacatcccatggcccggcgcagtggctcatgcctgtaatcccagcactttgggaggccaaggtgggcagatcacctgaggtcaggagttcaaaaccagcctggccaacatggtgtaacaccgtctctactaaaaatacaaaagttagccaggtgtggtggtgcatgcctgtaatcccagacacttggagactgaggcaggagaaacacttgaacccaggaggcggaggttgcagtgagtcaagatcacacctctgcactctaacctgggcaacagagtgagactctgtctcaaaaaaaaaaaaaaaaaaaaaaaaaaagagcagacacatcccacaagcactgcacaaaaacctgagctttgcattaacaggaccaccagcgaaatgctctgggctgactggctcacgtattagaaacaatcactggaacaagggaggatgggatcaacctgattggctttgaccactgggacaggagtcaaggtaagctccaccccactcccttggcagcaaggcagcaacatgatggggtggggtgaggggaggtagatgtatgtagaatagatgttggacagataaccacagtgtccactgcagattttagtatgaattgcttgtttctaattttcattactacttattgatttgtaggagctctttatatatgatgaatattatgccttgatatggtttggctgtgtccccacccaactctcttcttgaattgtagctcccataatccctacatgttgtgggaggaacctggtgggaggtcattgaatcatgggggcgggttttcatgtgctgttctcatgataatgaataaggctcatgagatctgatggttttataaagggcagttcccctgcacacactctcttgcctgctgccaagagagtacatgtaagacatgtccttgctcctccttcaccttccactgtgattgtgaggcctcctcagccattaaacctctttttctttgtaaattatccagtctcaggtatttcttcatagcagtatggaaatggactaatacatatttttatgtaaattgtgaatatttctcccagtctattgcttatcctttaactttattttataatttttgtggtacaaaattttttaagctttgtgtatcaaatctgtcagcccttcccctactcttttagtccaagcaggatttgaagtgttttggggcggaagggaaaatgatggggagcagcagtgcccttcaagaccttggaaataatgtcacctctcggaattaaaatgacacccagtgaatgcaattagtgttctggaaaagagaattgagagactgtgtaaaagtgtggaacggagactttagggtcacagcaaacttccgtcaggctgagcagaggtcatcaccaggcgcaggccagggggcattcattgattgacttgtttatttaatactggacacctactctgtgtcaggctctgggccgggagctgaaggcagaggtgaacattaccaagtccttactcttatggagcttatatccctatcagagagataaataataactgcatggcaggccaggtgtggtggctcacatttgtaattccagcactttgtgaggctgaggcaggtggatcccttgaggtcaggagtttgcgaccagcctgaccaacatggggaaaccccatctttactgaaaatacaaaattagccaggggaggtggcgcacacctgtaatcccagctatttgggaggctgaggcaggagaatcgtttgatcctgggaggcggaggttgcagtgagccgatatcaagccattgcgctccagcctgggtgacaagagtgaagctccatctcaaaacaaacaaacaaaaaaacaaacaaaaaaaccctgcatgcagaccccctgttggtaagtgctatggagaaaaacaaagtcatataaaggagtgctgggtcagagtagctacctcttttacatgggcagtcaggaaaggtttagctaatcctaaggtggcattcacatgagcagagatatgaaggtggtgagggagagagcttggggaaaaaaaaaagaagaagagcatggcaggcagtgggaacagcaagtgaagagaccctcagcaaagttcggggcggcaccctctgcctctagggaagagtcaggaggccaatgggctggggcagcaggcaagggagggcagaaagagatggggaggtgtgatggggaccagacggggccagatcaggaccagacggggccagatcgggcagcacctttaagtcattaggacttcagctttcctctgtgtgagataagacaccactggaggattgactgtgagtcactaaacacccctgagatctttgtattaaaccctgcctggagaaagacaggagacagagacagtcagtaaaaaaacttggaaaggcggccccagagagccagaagtcagccatgtgtcctagccatgttcagggaggagagacactggctgggaaatcccagaatgggccaactgaaccatccatccccacatcaaggtgataacagtatccaccttattgagataatgacagtgtggtgcttagcgaggtattgagcacatggaacatcctcctggctgttttatgtcatgataacatatgatcatatgtgtaatcagacatttttagtatacagtctgccagtatagctctgggtgagatgttcctcaggcaccccatctcattgtgccctgggttcacattcaatggcaaccacttggtggctgagtccattacttacagaaggaggggaggagtagtcccaccctgtgaggaatacatacttcaggccttttcggatttctgacacccaaactggacaataatttcaccacttaaaactctctagggggccgggcatggtggctgacacctgtaatcccagcactttgggaggccgagacaggtggatcacctgaggtcaggagttcaagaccagcctggccaacatggtgaaaccccatctctactaaaaatacaaaattagccaggcatggtggagcatgcctgtaatcccagctattcgtaggttgaggcaggagcattgcttgaacccaggaggtggaggttgcagtgaaccgagatggcaccattgcactccagcctgggcgacagagcgagactccatctcaaaaacaaaacaaaaacaaaacaaaaaacaaaacaaaacaaaacactcttcagggactccccagtgccctcggcacaatgtgatgactcctgcaggtggcctaagtggcctgacagtaccattcagcctcatgtctccactttgcccccagcagatgagtgggcatcagccggtcaagcactctactcttgtcccacctctgggcctgtgtctctacctggagcatgcatcctttccaccttcttctccccagctggctatgtccccctcatcccacaagcctctgcttcaagtccctgagcagatgctgatgatgactgcctgtatgccccactcttcccactcaatgcacatcagctgacccctagctggcaacacccatgtttattgcccgagggctttctgtgccactgggacccactctgccaactgcagggcaggcctgaagtgccagggaattaaaacttctctcaagaagcagccctcaaacaaagactgacaggacctggtgtataaataccccagctctctccctccttgggcagggtaatgctgaggaacttcatgcggctctcagaattttcctttggaattaagccctggtcacccacagtagtaacttgattggcaatacaccttctttggctgtctttcctgtcttccccacttgcctcccaggatgtcctttttctccaaagttaatgatgtgcccttgaatacttgtctcagggtctgcttggcaggaacccatactgaaagccattgcctctgaaaagccttccctggcatcaccagtgcttagacgggggatccagatgtccccttctggctctaccacacccctttcccatcccagtcacagcacgtatcacacagtcctatcactgtccaggtccctatggaaacacagatgattcactaggaaagaagttaaattggcttttatttgtttgtttgttttgagacagggtcttactccagttgtccaagctggagtgcagtagcgcgatctcagctcactgcaatcctcccatctcagcctcccgagtagctgggactacaggtgcatgacacaacacccggctaatattttgtatttttactagaaacggggttttgccatgtttcccaggctggtcttgaactcctggactcaaagaatccacccacctcggcctccagaagtgctgggattacaggtgtgagccaccacacccagcctggtttttaaacagttaaaggaatggtgaacttcactcataattaatgaaattcacataaagaatgccagctgacaaatgcaaacaaaaggacaaaattagaaaatcaccattttctaacgatagtaactgattcagtcaaagaccatcaatgaatgaggaactggacacccacaaggtgctggtcagaagaggagaaatgaatatttacctagagaggagtggtcaccacctgaaccccatgatcaagcttggcattattagtagtaggacagttagacaccaggtaaggtgaaatggagcatatagcaccactcgtgaaatataattactttctcatccccagaatgttccacctaaatctaatccatccattggatctaaatactagttttggggaaatataggagagagtacaggaagttaaaggacaccacagtgaagcaacgtgacagatcccagagaggaacattgtccaaaacaactggcccagtctcttcatgagtcaatgccattgggagtcaaaaaaaaaaaaaaaaagagtgaggaccatattagattaaaatagacttaagactgcaggaacaaaatccattacatggtccttgattggatcctggttgaaactacctgtaaagacatttctggcaaaactggagaaatttgaatataaatatattttttgagacagggtctcactctgttgcccaggctggagtgcagtggtatgatctcagctcactacaacgtccatctcccaggctcaaacgattccccccgcctcaacctcctgagtagctgggactacaggcacatgctaccacgcctggctaatttttgtattttttgtagagatggggcttcaccatgtcacccagggtggcctcaaactcttggactcaagtgatacacctgcctcggcctcccaatgtgctgggattacaggcatgagccaccatgcctggccttcatattgctaatttcttaatatgaaaattgtattttatgtaagaaaatgacctatgttagatacaaattatgttgatactttataaatatctactactgatgtatttagttggagaaatatcatgatgcctgtaatttatttcaaaatacttcactccccaattaaacacatatggcaagattttcacaatacttatatctaggtgatagatatatggatgttcattgagttactttcatatgtttgaaattgttttgtaataagaagaaaaaaataaaagcaaactaaagacataccattttctacccatagattcacaaagaaaaagttttaaaataggctgcgttggcaagggtgtagggaaatgggcactttggtacaacctctttgaagtgatgtttggcaaagccatgcccttccatccagcaattccgcttctaggaatttagcatacagagtatatagaaatatgggcaaatatatataaataaggatattcactgcagctttatctttattataaaagatgagaaacaacatatatgtccatcaatagaagttgttaagtaaattttttgtggtctattcatgtagtacagagtcctacaaagtatagggtagacgtgttgtgctgataggaaactctttccaagatgtcttgctaagtgaacaagccgaagagcaggccagtgtctgtctgtctgtcttattgctgtatctctggtgcctagcaacgcacctggcacacagtgggtccacaattaatattagttgagggaacgaacacacatctgagcatgactgctgtgagtcaggctccctaaatgccaccagtttcaagtcactgataggggccagattttccaccgccatcaaatttccatccaacaggatgggcactcctggtccaactgctggcatgcaaacccgggtgccagctattctgggttttcttgaacctggaaatccagatatttgtgtgaaattgctcattttaaaatttgtcaataaaataacactgggtcaggcataacagaacatatctgcagggtgggtccaagccaacacattgtcagtttgcaacttctgcattagcgcatttaatttttgccacactcccggaggcagtatgttcagtaacatagcacttgctgctataacagatacaaacctcagtggcttcacacaatagaagtttatttttcactcatataaagtccagctggcagcaggtgtggggaggaacaaggagttttatcaaccttcccttggggctttcaagttcctccaggcattgatattcaataggcggatgggaagagagagtgaagaatcatggggattttatgggcagcagcattcctcacttctgcccacattcattggccacaagtcagtcatgttgtcacctcacctcaatgcaaagtggagcagtccctggtgagtggcagccactttccagcaactactgtgtcctatggactgagaacacagatctctgggtgacagtgatccatctctgcctcatgcagttatcattatctctatttcacagatgatgagccgaatctcagggagggtaagtgacctgtgagaagtcacacagccaggagccctatcttactgcctccaatccagggatctttcctctagctcagtgtttcccagctgtgttagaccattctcacattgtgataaagaaatacccgagactgggtaatttataaagaaaagaggtttaactgggtaatttataaagaaaagaggtttaattggctcgtggttctgcaggctgtacaggaagcatggcactggcacctgcttggcttctggtgaggcctcagaaagcttccaatcacggtggaaggcaaaggggaagctggcatatcacatggtgagaaaggaagcaagacagagtaggggaagatgtgccacatacttatttatttatttatttatttttgctttcttaatctgttcctgaccacatacttttaaacaaccagatctcacaagaactcactgactattgcaaggacagcaccaagccaagaggggtccacccccatgatccaatcacctcctaccaggccccacctccagcactggggactacatttcaacatgaaatttggtggagacacagatgcaaacagtatcaccaaccttgcatctcatgagaatcacctatggcacttgttaaacctaccagattgtgaccctgggagcatacaggattgaattttccttcaagacataccatgcccttttttgcaaaattgaacagtgaacaacatcaaaaatttcacaagagtgacaaaaaaagtatgctgaaccagggaggctaatgtagcaactgagacttgatagaaaatgtagctacaggctttgtggcagccaaggcaaaaagggaaacccagggaccacagagcatctgttatctggtagaaggaggttcaccggttccttatgagccaggcttacagcctgggggatgaggtacccaggagtccttagcagcatgatggatgggggtgggcggtcgggggtgagagggaggactgagcttatcttcctagtacatctatttgcatctgttgtcccagggtctgcttctgtatttcctcaatggtaaataaattaaaacacagtatttatagtaacggaagtataggtgtattaaggaactttgctgaagttcttatgtatgtttagggcagactttgtgacagcaaaggcattatgggctttctttgggctcatctggttgtgccttggtagaagatgcaaccttgaacaaatgacttgacatttctgagcctcgccttcctcatccgtgaaaaatgattattgtgcagatgaaatgagatgatgcatgtaaggggctcaggttgataaatggttgctgtgccattgtttatattcttaccatattatcatgaccttatggctaggagcacagactctggagccagactgcctgtgttcacatcagctccaccacctaccagctcgatgaccttgggcaaggtcacttagcctctctgtgcctcagtttccttctctgtaaaatgaagctaataggactattgtgagagctaaatgggctgatagttgtaaagctcttagaacagtgcctgggcatacagtaagtgctatgtaagtgtctgttaaataaatcatagtctgttccctctgcccttcgaggcccttcaggggaaaagttagaagataacagcttcaaagcgagacaagtaatttccagacactaatttctaaaggaatagctctctagaatcccagttaagaagtatttgccccttagaagactgagaggcaggaaagcgttgatgagggtggaatctttggcaggtgcctggcccaatacactgagctgtttggggggcacgacccacttcctcgggctccttccacccttgcagggagcctgacactgagggctggcggcttttctggcgcgggccagggggaggaggagaaaggagctcccgggatcccctcgccccctcccccaactgcccggtgagtaatgacattcacggagcggggagggagggaggagaggggcaggctcggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtagagccgggccgggagccgcctgcgccggtggccaggaagcttggggaggggagccccagggcttgagggatctgagggcggcgaaagactggaggggggaacctggggtttgggggtcccggaggtcgggggacgcaagggttccttccaggactgctcacctgggaagcgacaggccctgtctgggccccaggagcacagttctcaattttaggagcatccattctgcctctttccctcccagaaacagccggtctgttggggtgcggggcgggttgggggggctgagaaaagagacaaaggcgaggggaagggaatgggcactgctgggaaggcggcttggtggggtgggaggtgctgctgctgcggggagggagaagaagcgctacttggggtccagcctcggtagccccctctcagtcgctccctgcacgctgccgtcccggacactgcaggcccccaggtcacagctcctctgcccctctgtctgcgggccgccttctggctagggcttggagggtctgtccccagtcgtcgcccaccccccactccgtgtcttgagctgagaaggaaggagttaaaccatcccctcacaccagctcggctcagcccatcaggtctgttttgctcttaaaggcacagagtggccccagcccctaaaatgcttctaggacctaggggacctgaggggcagttggaaatccaactggattctcagggttcccgcttcctgggggtaaggctgtgaactgcacccctcagacaggggcgcctctaggggcgcaatctcccaccctgggcggttgtcccgtctctgggccacggattcagcaccatggccagggcccagaggcaggtcctgcaggggcctaagcggcaccactgcctgaccttctgactcctcttcttcctggaagatccttttgttccattcgttcattttccagatggaaaaacagaatccatgaagagaaagggccttggaactcaaagacttagatttgagtcttggtccaggctcatttcatcatctggaaagcgggatagtgatacaacaatagccacttccaatcccaaccccttctcagggttgctgatatggttgttgaagaagggatataacttaggaacttagtgttatagactgggactactcaaacttgagcgtgcattagagtccctggatgatcctggttaaaacccagactgctggattctaccccaaggatcctgattcagtgggtctggaatggggtccaagatgctgcctttccaacaagcgaccaggtgatgctgatgaagctggtccaccaatcatattgcccactgactcactgtggagctgtggacaggtccctttgcctgtccaaagcctcagctttataatctgtaaaatggggtgaatgcagtaacttcctcagagggctattatgagagtgaaatgtgatatgatgcacaaaagtactgatgatggcagtgcctggcgagaggtcaagactctgttgataatgagtgttatgatttttttttttttttgagacagagtcttgctctgttgcccaggctggagggcagtggcatgattttggctcactgcaacttccgcctcctgggttcaagtgattctcctgtctcagcctcctgagtagctgggactacaggcatatgccaccacacccggctaatttttttatatttttggtagagacagggtttcaccatgtttgccagacttgtctcaaactcctgatctcaagtgatccactcactttggcctcccaaagtgctagtattacaggtgtgagccaccaggagcggccgttatgatgttattaaggcactaggtaaaggaggggccagagttaatcaaggtcatactggagtcatccacaaattctgcacatgcttgcacgtgccaggcctcattcaaggagcctggggatgggggctttggagatgaatcagactgcccttcagagtctagaacttcctccccgctagaacctcaggaagtgggccccagcggctgggaccagacagggggcagggaggtggcatctcccacaaccatatcatgagggagcctcctgttctttgcctcatgaaatatttcctatgtagcgtgagctcagggctgaggtggcccctgagtcaggatgagaccatctgctgcagccccacttttgaccaagtctctggccaagctaacctgggcatccttctgtctcccataccagggccttccccctacccaggggcccatggtggattctagaagcagtgtagcttggcagaaagggcatgggctctgcagtcatatagtcctgggttctattctcgtcttggctacttactggctgagtgaccttggacaagtcactttacctctctgtgcctcaatgtccctatctggaaaagaggattttacatcctaccctgcagaattcctttagaagacataggcatatgttaacttcctggcatgtagtaggagcttagcagatgagttttcttccttctctccaatcctgaagggccttaattatataaagagggcagtcccccattgtcaagcatctaaatagcctgtctttaatggcacatgaaatatgaatggaaaaaaatagtccacctctaggagtgatggtggctccattgggcatttggagatcattccagacccagagggcaacaggacagtgtgtgggtccaggcccaggctctatgaccagactgcctgggcttccatctcagctctaccactgaccagctgggtaatcccgtgcaagctgcttaacctctcatgccccagttatatccacacctgtaaattgagaatattaatggtgcctccccaacagggtcgttgtaaggattcagcaaatgtatccatgtcaatcacctagaatagcacgtggcacatagaaagtgctcagttaagtgctgggtgctgttataaaggcatggattttggaatcagccagacatgcggtcaaaccccaactctgccattcccagctatgtgactttgtacaagtgtcttctttgcctgtctaagtcagctttctcatatatttgggggagagggttgaggagattgagtgatatcatgcatgttcacacacttagcacaatgccttaaacaattgcctgttaagagtgagctttcaagcactatcataggtcattgcttggggccacagggtttgaaggaggctctaaatgcctaaggtcaatgttaggatgcttctgaggctgttcctgcccccagcctcctcctcctttgtggggaagaatgaggccaggaggggcaaaaaagcatagagtcaggagaccaaggttctagtgctgccagtcccactaactggctgtgtgacctgaccctctctggtcctcagttttctcagcagggaaatgaaccagatgtttgatacaacgtgcctccctcctccttcaccaggcaggaagaactgccctacctctcggtgcccgttgactttggggcatccatctgtcctcacaactgccccttttcaaaaaccaagactgctacttcctagctgtgtgactgggcaagttacttacaatctctgtgcctgcttccttttcttaaaagtgagggtactgggaggtactagtaccaatttcattggaattcatagggattaagatctaatgcatgtaaagctctacaatagtgcctggcacagaggaggtgataataagagttggctgttgttactgctgttatttccaccagagtgagtctctgagggtcgtctctggctccctgcagcaagcctggttcatggttcccttactgcctcctctcagggtctgccctgtcttggatgtacctctggagggcccctggcccagccttcagatcccaggggcaagagacccaagtctggggcctgccagaggccagttcagacacccaggcatggcaggagagaagcaagggggtgaaggatgagttctctttcccaccctgcccttgcctttcaaactcttagggctgaccctccaacttgtccatgctgcacttgaccgtgtaccgcctcccttcacctaagaggagccccagagaggaaagctgatgggggcagcaacgagatgcatctccctgcttctctgctcagaagcctgcagtggctccccaggtccctcaggaaaactccagagtcctctcaatggcctcaggccctcctgcagggtcctaaccttgcttgagtcaagacctaagttgggggaagcttatgggcccttctcagaataatgtttttaattgaataaaataaaatgtataggatttttagattagaacgaaaaccaatcgtattgaagtacggcgttatataataatatttatgtttctttattaaccccttatataacacggtctggtggccggtctcataacaactgtcatgttggagtcgtgatgagtgcgcatgatattttgagacaactgcaacaactgtgaagtgatgaaaatatctgattcctagtggtgacaatattgcaggcactgctaaacgctaccctactttatcgcctacattcataattgaagaaaatgctaactgtcagtttgagattactgaaaataaacatgtaattttcccatcctagttcaaggagcccctgaattaattcatggaccccttggcctgggagtgtggattaaaagatcctgtgcacaacccggccaggcgtggtggctcacacctgtaatcccagcactgtgggaggccaaggtgggtggatcacctgaggtcaggagtttgagaccagtctggccaacaggtgaaaccctgtctctcctaaaaatacaggctgggcgtggtggctcgcgcctgtaatcccagcactttgggaggccaaggcaggcggatcacctgaagttaggaggttgagaccagcctgaccaacatggtgaaatcccgtctctactaaaaatacaaaaattagctgggcgtggtggtgtgcacctgtgatcccagctactcgggaggctgagacaagagaatcgcttgaacctgggaggcggaggttgcagtcagccgagattgcaccactgcactccagcttgggtaacaagagcgaaactcaagctcaaaacaaacaaacaaacaaacaaaaaacaaaagttagctaggcatggtggtgcatgcctgtagtcccagctacttgggaggctgaggcaggaaaatcgattgaatccaggagatggaggttgcggtgagctgagattgcaccattgaactccagcctggacaactgagtgagaccctgtctcaaaaaaaaaaaaaaaaaatcctatgcacaaccctttctgctcctaccctcctcgtctattcctgactgctctgctccagacacactggcttccttgctatcttttgagtatgtccaacatgcttagagccttagcactggctgttccctctgactgaagctctcttccccaggtccctgtgtggaccacttcctcacttctttcaagcctttgctcaagggccaccttctcgagaggcctgccctaatagaccaccttaattaaaattgctacctttatccctgacaccatggtaccccgattccccttccctgctctattttctctttttttggacgcactcaccgtcttttgacagaccaaattgcttaccatctgcctgcccccacggacatgtcagttccctgagggcagggatcattgttttgttcactgctaagtttccaacaagacctggcacatagtaggcactcaataaacaagtggtgaaaagtgatggatttgcaagctgtaaggtgttatgttaaaaagccatttgattctgtaaatctaaaactgctctaaaaataaggcctactaatttttttaaaaaaagaatttgaaataaactgaggtcagagatgctaagtgttttatacaaagtcacaccgcaactaaatgactaggcagagacaacaacccagcccatcacataaacaagggcctgggtgaggagaggcagtgcctgacccatgacaatgcggcactgtgggtgattttcaggcaccaacagggaagttcgtttacctagagatggttgatgtctgatcacactaagtggtgaccacctaggtctggtccagcctccagggggcagagatggcagatggccttggtagctgaatgcccttcccttaggcttggcttcctctctgggtccccttcctccacagggtgacacatggctctggcctgtagctcagctaaaggtgaaagtctccttggccgcctgccagggtgaccccaaagcagctccaagcaggattatcatgcctctaaagatatagtcccctccccaaatagcagccctgatactttcatgggagacccagggtagagcatgggagcggcccctggaggcaggtgccctgccaagatggaaggccaactgtctggccctaccaagggcaaaggcctggtttggactctgtttccacccattcagaggtcccagcttggcctggaggatggagggccaggtaaagacaagagaagggggctttctgctccagccaaactccagtctccactactctgggcttctccagggcacaggccgcccatgagctcaaatatacacatgcatacctgctcccacgcatgcacactcacactgaccgggaacacacatggcacacactcacatgtacacacatgtgcactctcacatccacactcacacagtccttgaatactcacacttactcatacactcttccatgcacacccacactcacacacacgcagacacgcaaacacatttgctcactcatacacacgcactcacactcagacccaaacagatgctgcccccaggctgctcactctctgcaacagtttttccccctctctcagacagaacgagaagctccctcccactgccgaggagggaagcagagccagccctgtctcctgcctcctgcaaggttgtgaatgtagtagtgtcagcttgcagcagggctgcggggcactctgtgaacactgaatccagcccccttgttttgctgatgagaaaaaggaggctcagaaaggggcagtgatagctctaaggtcacacagcattgctatggcagatccaagatgaggacttgagtccctgcctcctagcccagggtctctacctgcaccatgcgccccacctataggacctgctcttggctaatggagcaaataagtctgtgaatgaatgttgggtgtttcagggcaagttacccttcccttcccatgatccaccaaacaggaggaggtgtttatgttcactgtgagggtggggcatgaagtactctaggacacaccagggtgtgtgtgtggtgtgtgtgtgtaataagtgatgctagaactcatgtattaaccttctgtgctggggctgtctccacaacagcccatttcaacctcacacttgcattcctcacttcacggaagctagaaatcagagagagcaagtgacttgttcaaggtcacacagcaaataagcagtagagctaggcttccaagtcaaagtctgtctgcctccaaaacctgccctcataccagcagctaagacacattacccctactgtgttccaggcaccattccacagggactaaggaatttcatcctcacagcgggcctccgaggcaattactataggactcccactggataagaggggaaactgaggcacaaagaagtaaagctgcccaggcatggtggctcacacctataatctcagcactttgggaggtcaagacaggtggatcgcttgaggtcaggagttcaagaccagcctagccaatatggtgaaaccccatctctactaaaaatacaaaaattagccaagtgtggtggcatgctcctgtaatcccagctactcgggaggctgaggtaggagaatcgcttgaacccaggaggcggaggttgcagtgagccgagatcgcaccactgcactccagcctgagcaacagagcgagactctgtctcaaaaaaaaaaaaaaaaaaaaaaaaaaaaaagtaaagctacttgtaaagccaagtcatccagcaaataagtgtaaagctgggatttgaaacaacaccgttcaggttctgcccatgacgctgcattgcctcttctggatgcttaacttgtcccaggagccaccatctcagctgtgggtggagacattgatgctcaaggggaatgggcctttcctcttttggggataccctccctctcccctggaccagagtggaaggtggggagggaagcataagaatggggccacttgccatcttgccaggggatcttggacaagcccatccttccttctgagtctcagtccacaggcagggggcaataggactaggtgatctctaaccatcttctaacttagaaatattgggctgggtcaggagcatgccccagcctcaaggctctctggcagcttctaccagctcaaatgtgtgtctgggagcccttagaaacataaagaaagactcaggaaggggcaggcccagaactccctggaaggagccctcagggcagagagcactggtttgggagtcaagaaccttgcttccagttttaagtctgctgctgaattgctgtgtgactttgggtagattacttgccatctctgggctttagttttctcatcaagaaaaatggggagatactgttctaccctcctctaggggctgttgtgagtttccaaccaggcaaccagatgaggtgtttgggggaaataaagggctcgactaatgttggcaagttacttttcccctcacttagtaccccaaataatttgagaaatttagctgttgattatgataataataagagtttctgaccaggcacggtggctaacatctgtaatcccagcagtttgggaggctgaggtggccagagcacctgaggtcaggagttgaagaccagcctgaccaacatggcaaaaccctgtctctactaaaaatacaaaaattagctgggtgtagtggtgacagcctgtagtcgggaggctgaggcaggagaatcgcttgagtccaggaggcagaggttgcagagagctgagattgcgccactgcactccagcctgggcaatagagcaagactctgtcttaaaaaaaaggggaaaaaaaaaagtttctgtgaatttcctggccagatctactcctaggggccaggctgagtgctcaactgtgataacgacgatcacaaattgagtgccaataatttgtcccagacactgggttggtactgttaatactatcatttttaaaataagaaaactgaggcccagaaagtttaaggactgcccacactcacacagccaggaatcctatcccagatgtgtccagctgtcaaatccagccccttagccaccaggcagcactgccctttgtcccccaagcagaactgcgctcctccctccaccaggcacatgcccctgggagatatccccccaaacccaggtgcccaagaatgggctgaaagcaatcgtgtcccctcctgtgtgtgacctctgacctccctccccgcacacccccgccccacctgggcagagtgtcccctgtgtccgcccgccttccccgctctgaccctggcgcctgcaggtgcggctggtgatcgccgagaagggcctggtgtgcgaggagcgggacgtgagcctgccacagagcgagcacaaggagccctggttcatgcggctcaacctgggcgaggaggtgcccgtcatcatccaccgcgacaacatcatcagtgactatgaccagatcattgactatgtggagcgcaccttcacaggaggtacggctgcctccccacccaggggcccactccataccacagatcctcaggggtccccacaggctcagacggggtcccagaactttgggaagtctgggaaattcactggagccatgggcaaggcccagtctccccaaaaaggagccacagagccacaggcagggttcagatgcccccagagccccagagccacaggcatagctactgatccatacagagacctcccctcccctggtactgtaagggcatgacccagacacccccccaccaggagcagtggggctatagccctttcccccgagctctagagtcacaggcatggccccttcagcatgagtggccccagaccaccctctaggtccccacagacagggtccagatctcccaggggttacagggcaaggacagggcccagctccctctggaacatagattccctaggaccccataggaacctgaagacatgttcccagacgccccagaaccctgagacaggggaaggcccagacaccccagaaccctgagacaggggagggcccagataccccagaaccccatggacaggggagagcccagacaccccaaaaccccgcaggcagaggagggcccaggtaccccagaacctcgcagagaccccgtcctctcccctcgtaggccctcctcaggctcaggaacttactgcccattgcataggctcagacacccactgggagggcatcagggcccagacatgcactgttttaaaagaatgtgagttggttgccaacatttaaaagtcaaggggacccaagcattgagcacccaggttgcagcttctcttgaatcccgcaacactgggtctaggaccccgcctggcagcaagtctggagctgagaggagctaaccctcggggacagcttggcagagcccagtgaggagagatggccgggccaccactagaatcccctgtccgccagcagccaagcccgagcatgggggtgcccagggcctctgggcagagacatcttggggctcagggatgccgggggcaggtggccggggcaggtgcccctctggcttccctgcccagcccctggcggtgcccacagagcacgtggtggccctgatgcccgaggtgggcagcctgcagcacgcacgggtgctgcagtaccgggagctgctggacgcactgcccatggatgcctacacgcatggctgcatcctgcatcccgagctcaccaccgactccatgatccccaagtacgccacggccgagatccgcagtgagtgccagggcggcgagacagcccctctgctttccccctttgcgccgctcctttcttccaaaggatgtcctccctctcctgggcctctctctgtcctccccttcctcctccttctctccctcttgcattctccatttgtccccgcctctctctgagtgctcggggttggtttctcactctgctggtctctctctctctctcttgctctttctctctgttcctcttgcttgccatccccttcacccccgacttcccggccttccatctcattcacccagtttctaacagaatatgtctctctccctctctgccagtctcgctcccatccccctcccctgtcccctactcttgtcctgccccccccatacacagactatggggctgtctgtccccacaaggtttgttctccccgcacgagtttcagccttagacagtcagggctgtgcttcgtggccaagggctctgagtgacctcagggttaggattaccaaggaagactacccagatgtggcaaggcccccagtgaggtctcagattgaaggttacccatgagcatgtcctgtcctaatggccagcctggacatgctcacagcctacttcatccttttgtatctgacacccagtgaatgggtgttggattaaatcagataatccctcagcagctgtttacagactacgatccaggctttgaacaaacaccatggggtcctacagccaaaagacacctgaagattcttagtagataataggtgctcagtgaatggtcatgtcgtccccctcaaaggaatgtggctaatgttcaaaggcagggttggggcggtgttaggttgtagaactcaaccctgtcccttgagaaccattgtcattgaacaagactcagaatttttttttttttttttttgtgagacagggtctccctctgtcatccaggctggagtgtagtggcgcaatcttgactcactgcaacctcctctgcccagtctcaagcgattctcccacctcagcctcccaagtagctgggaccccaggcacatgctgccatgccttgctaattttttgtatttttggtagagatgaggttttgccatattgcccaggctggtcttgaactcctgacctcaggtgatctgcctgcctcagcctctcaaagcgctgggattataggcatgagccaccatatgtggccaagactcaggatttacctgtacatccggctcccagcaacagccccctcaacaacatttatgaggccctgggcaggggactggggacaaacaggaatagacacagcttctgccatcccagggtcaagttccatggaaggaaagacaagtcaccagccaattacagtgcagaactaagtgagtttgaatgcgctctcaggagggcggcctggtactctatgtcaaacatgagaaagcccacatcttggagattaccctgcagttacacttgaacatatgcaccaagaagtatgaacaaaggtattcactgcagcacagttggcaagagcaagaatatcgctggaaattacccagctgtcatgaattgggaactgggtaaataagttatgggtacttccatacaacggaatactgtgcagatgtttttaaaaattaataggtgtatggaatgcttcctaagatatattagtgagtagaaaaaagtgaagggcaaaaaaaaaaaaacaacatctagtgtgctctcattagtactcagaatgaggttaaatggacacacaggtgcttgcactgcaaggagtatttctggaaggatacacagaagctgccaatagtttgtgtctttggggagcagaactaagagactgcagctgcagaggacagagatttacttttatagtacattcttcaatcttgtttgaatttcaacaatatacatgtatatcctgctcaaaaataaattcgtttaaaaacgtttaatctggtgcccatgagtgttatgagcaggagatcagggaggttctgggcatacacgatgtccaccccagcctccggggccacagaagccttccaaaatgcagcagcgaccgaggatgtgtagcaggtagaaggggagaaagagggagaattatttcacattctggagtaggacagggtgtattgtttttggggaatggaggaagctcagtgtggtgcaagtgtagcccaaggtggggtggaaatggtcgtggtgtgtgtctggggaggagggtctggcagaatttggattttgtccaaagagcagtggagaaacggtgatgggaagtgacgtggtcagatctgcattttacgaagatctctcctctgagggaagaatgaacggggtaggccctggctgttggtaggcagggtcctggccaagggctggaggcagtccccaagggcttctgggaattaggggcactctccctcaatcttgccctgagccatttgaaggtgcctagaaggcactgggagtccagagcagacccagcccaccccctctctccccatctttctctgaggaggcagagaggatctcagggctccagcccagctgggggatgagaggagggaggtcccagagtgcagaaggagtagaagccagcctgcagcgaccccttaatcagtctcaagtcttctcttggggtggcctgccctcctggagtctgaagccaccacatgggcagcgctgggtgacacgcaagaaagatgctgtccttgaccttcacattcataaaacatcaatgagacttaatatagccctgaagctgaatgatctgggagtgcgtttactgggatttgtgtcaggacaggagatggggcagtaggtggtgaaatctcagatgacagaagctaaacaacctaagtcactcactcatttcattcattcattcattcaacactcactgagctcctgctctgtgccaggcctgtgttgagttttaagggaacaaagatgaatctgacatagccactgctctccagaagctcaagtgttagagggagacatacacattcagtgataactacgttagcaccaaaatctccatgtacagcaagcaggcaggttgtggactcaagcccaggagggctcttttcatatagacagcaaggttaatggagttgtgaatggcagctctgattagcgtgtttgcgttccctggcagaagtctgtagggcgtaaactggggaacaaagacattgagcgggcagacctcctacaggatcaggaagggcttcctggaggaggaaatctttagctgaatctagaaggaagctttcaggaaaggaggataaggctattttaggaagaagtagtagtatgagcagaagcctggaggtgtggagtggtctggcacattcagggaacagcaagcatgtacagtggctgaaatgtacatattgggacaggaacagttgggaaaactcagtgaaagatggagtaggtgagagggagggcaagtggatcctgaaggctctttgaaggcaagttgaggagctaggatgttatccgagggcagtgaggagccagggatgggttttaaacagagtggcatggtcaagtgtgtgaagaagatatctctggtaggggtggggagaagggcctgtaagggagagaggggaggtgacagagggtgggtgaaaccatctaggtgagacattaatggggtctgaactaagagagagtcagttaaatggaggaggttaaatgtgaaaaaatatgagaaagatggaggaggaagaatcaacaggacctgggaatgacttgatgtggggtgaggtagtgggaggagctgagggcaaatccaggaatctggctgggctttgtgttggggaggggatgctgcaatttgggaagaatgcagggggagaagcagtgaggcagggaagatgaccaggtctagggttgggtctatcggtttctggcatctactactcgtcctcaagggtacagtctcctcctccgtgaggtctctcagccccttgtgccccaggcaggcagcccctgggtccctatgccttgtgttcactcttccctacagtttactcatgctgtaccatagagtttatttttattttttttaactgtgtattttataatattgctgatgtgtattatttatttatttttgtatttttttagagtaagggtctcactctgttgcccaggctggagtgcagtggtgctatcatagctcactgcagcctcgacctcccaggctcaagcgatccccctgcctcaacctcctgagtagctgggactatggtgtgcaccactacacctggctaactttttttttttaagatgggttcttgctatttgcccaagctggtcttgaactcctgggctcaagtgatcctctcacctcagcctcccaaagtgttaggattacaggggtgagccattggctgagatttctttatgtgcctatctctcccaccagcctgagctcagggcaggatggcatctcatccatcactacggcacagcctgcagtgctccctaagtgttggctgtcgacagtattactcttctgaccagtgtttggatggggcctacttcaagttgtgtaaggcaggtgatgggggagcaaccaaggtatcagagggatgggacctttcctattatctccccaggacatttagccaatgccaccacggacctcatgaaactggaccatgaagaggagccccagctctccgagccctacctttctaaacaaaagaagctcatggtgagtacctcccggcctgctgagtccccttccctacgagctcttccacggaaatgaacaataggagaaactaagtagaagatcagctgatgatatgaaatggaaaagcccctggcttgcttttccaatcctgtcccctgccatttactagctgttagacctggggtaagccactgctgccctcgggcctcagtttcctcatgtgttaggttgtgtctttaaaagcagagcattggccaggcatggtggctcactcctgtaatcccagcactttgggaggccaaggcaagtggatcacttgaggtcaggagtttgagaccagcctggccaacatggtgaaaccccatctctactaaaaatacaaaaattagccgggcatcatggcggatgcctgtagtcccagttactcgggaggctgaggcaaggaaattgcctgaacctgggaggcggaggttgcagtgagctgagatcgggccactacactctagcctgggcaacagagtgagactctgtctcaaataataataattataataaatatataaataaataaaaataaatgcagagcactgaacaggggttcttgggaaaggaggtattgaaggattgctctgagggggaccccagagggatgggagggataaggaagaggaagctgctaagcctcaattgattccacaggaagctctggagcacaaatggcaccacaaaggtgatcaaccttgaagtaaggggccagccttttatcccctcatatcagtgggacattggctacagattgttggagggaggggtgcgggccggtaacctcccaggtatttgtgggcaatgcagctccttattggctgagagaaggggcagctgtgagccactagcagccagccctcccagcatctgggtgtaagaatgtactagggatctaggcaggacagccaagctcacaggactgttgtaggcaccagatgagggtgcttcataacgggggggcatcctatacacttggggggcatttggaggctgggtttgcagaagaagttcagcaaagctccttccatccctgaacatcctggctctattgaggccaactcagcttctcttggccctgtcctgcccccaggccaagatcttggagcatgatgatgtgagctacctgaagaagatcctcggggaactggccatggtgctggaccagattgaggcggagctggagaagaggaagctggagaacgagggtgggtgccagccctgggggaggtgggggctgcagcccacccagcctactcttcccctgcccagtctcagcctcttttttccgcaaaagtctcagaggacctcccaggtggttaagaggatgggctatggagtcagactaaggttcaagtcataacttggccacttcctagcttagtaaatgtggtcaggttctcccctctctgaaattcagtttcccatctataaaatggggataatagtaggacctgcctcaaagagctgttgagacattgtgtgaaataatacacgtagagtgcttagatcagggcttagcacacagtaggtgtttaataaaggtaggtgaagatgatgttaagaggcagctcatagatgtcatggttagggccagaacttgttccctctcgatgggtccagtgttgtttccagcatgtcacaactgataccacaagcacaagaccttatgtcccgaacagagacatcatcatgcatactgaatactcggttgctcccccatcacctcccttacacaacttgatggccactacccaccacaccatcccacttgccctgcccaagaatgcattatagctccttcgtgctccagccagacatccaagctcacccagactctcgttgaccttgactcttcctgctcccagctgggcctctaaacttggacatgccagcttcattctacctccatgcttttgctcccacagcccctccctcctggagcacccttcctacaccactccactccattttgcctgttgcacaccatctttgccacagcccttcttcaaatctcattctgagcttcccatcttgctccgtttaagacctgtgatgagtcttgtctcctgaacaatgcaaatttatggtgcatttgcaacagcctcctgcacatgcatggctatgtgtatgggaaggccgtagagcccagggtctaaacagatggggttagagtaagaaaaacttgaaatagagttccagctttgctgcctcaaatatgtaaccttggacaagttgctttccctattgaagcctcagtttcctcatctataagatgggatggtaataatacaacttaaccttgtcttgctggactcttgtgaaaattcaatatactcagcacactgcctgtcccattactagtttaatacatatggcagctaaagggacacacattctccagatgagaaaactgaggctcagagagatgaagtgagttgctcaaggtcaggcagctcatagatgtcatggttagggccagaacttgttccctctcgatgggtccagtgttgtttccagcatctcacaactgatgccacaagcacaagaccttatgtcccgaacagagacatcatcatgcatactgaagccagctgccttaaatcatttctggaaacaaagcctggtatgactaagtgagtaaaaaaaataacgcacctcaaaggggaacttttggctgggcacaatggctcacgcctgtaatcccagcactttgggaggccgaggcgggtggatcacctgaggtcaggagttcgagaccagcctaacaacatggcaaaaccctgtctctactaaaaatacaaaaactagctgggcggggtgctgggttcctgtaatcccagctactcgagaggctgaggcaggagaatcacttgaacctgggaggcagaggttgcagtgaactcagattgcgccactgcactccagcctgggggacagagagagactccatcccctgccccccaaccaaaaaaaaaaaaggaactttcctgtttctatcctaacggtagctaaggggagctgttgcagagttaatggctctgaggggccaaaaggcttggtagttcagagatgggcctttgggggacagagtcccagctctgccatgctctcggtgggtgaccttggacatcaagtatatgttattcacttatgcattagtttcttaggacttccataacaaaatactacagactgaggggcttaaacagcagaaacctattgtcacacagagctggaggctagacatctcagatcaaggtgcctgtggggtgagtttctctcgaggcctctctccttggcttgtaagtggctgccttcttgccgtgtccttacatggcccttcccctgtgctgcacatgcctggtgtctttgagtccaaatttcctcctataaatactttagtctgattgaatgaggacccaccttaagctcttcattttaaggtaattatctctttaaaagccctgtttccaaatacagtcacattctgagattttaggagtgtccaatcttttggcttccttgggccacattggaagaagagtaactgtcctgggccacacataaaatatgctaacactgacgataactgatgagcttaaaaaacatcgcaaaaaattctcagaatgttttaaggaagtttatgaattagttttgggccacattcaaagccatcctgggctgcatgtggcccgcgggctgcaggttggacaagcttgctctagagcttaaggcttcaacatgtgaagtttgtgagggtcacagtccagcccagaaaaatctatatatttaatagagcttactgtgtgtcaggccctgttctaggtgtttcacagatttcaactcacttaatccccataacaaccccaggaggtgggtaatatcagcgatcctgtttaacagatgaggatcctgtttaacagaggaggaagcactggctctgggctctttcctgttctataaaagggtgataggttgggcacagtggctcacgcctgtaaccccaacactttgggaggctgaggcaggtggatcacttgaggtcaggagttcgagaccagcctggccaacatggtgaaaccctatctctactaaaaatacaaaaaattagctgggcatggtggtgggcacctgtaatcccagttatgtgggaggctgaggcaggagaatcacttgaacccaggaggcagaggttgcagtgagctgagattgtaccactgcactccagcctaggcaccagagcaagactctgtctcaaagagaaaaaaaaaaaaaaaggcagggggtgataacatgagtgcctacgtcccagggctgctgcgaggatcaatgagcaaatgcatgtaaggggcttagcacagtgcccggcacacagtacagaagtgttcatatacattgtgatccagagagacccagggtctgaactggatggaggctagggtggatggttctggagaatagcctcagacatgcattccttgtgggattcctaggctgggaccctactgctgaccgctgtcctgaggtcttctgagaggagacagcattgcactgtcccatggtgagataagtggggttgctcaagatggagaggtgtcgacagtccttgcatccctctggggctgggggaggtagcagaagccccagggaagtggttatggattttaaaggtctgactggctgggcccacatggcctcggttgctcatccaggttccctgaacctgactgggttaaacacttttatgccttccatttcttccctcgtgggcagagcccagtgttggaagggattttaatgtcacagttgagaccccttgcatagagccagatggctttgatgcagattcctgatcaaccacctcctagctctgtgaccttgtggaactcacttcatctctctgagctcatctgcaaaatgttgatagtaatagaatcaaactcatagcagggttgctggtggaagatttgttaagatagtaaatgttgagtattttgcacagtgcctggctcaaggtaaaatgttctaaaaataatcattattaccattctctttcattcatgtattcaaatatttattgaacacctactagatggtaggtcctagggataaactaatgagtaaaactcagacctcattcttggtttcatggagtttgcagtcttacagaggaaaaagacattagtcaaataatcccataagtaaacacagaattgcacacagcgataagtgttaagattgagagtaaatgagcaggataaagtggataaagtttccctgagaaggtgatattcaaagtgagacctgaaggatgagaaggagcctggagaagaatcagggcagatatgacccagactgagggatgccatggagtgggagagaactgggaactcttcaggaatggtctgctgtgtggggagtcctcgggaaagtggtgggaatgaggggagagctggagcgggtgaggtgagatcacgggcctcagagcctacatttacaagtttggattttatactaagtacaatgggaagtccctggagggctttgaggagggtattgtatcagttagtttctgctgtataacaaaccattgcaaatctgagtgacataaaagaagggccttttatttgttcatgatatgtggcttggcagtatgggctgggctcagctgggacggcttgcctctcacacatggggagcggctgacctcattcctgcatttgcggccagcaaatttaagacagtaaatgttgattactttgcacagtgcccagctcaagatgaaatgttctaaaaattattattatcaccattctttttcattcattttttcaaatatttattgaacatctcctagatgctaggtcctagggataaattaatgagcaaaatccagatgtcattcttgctctcacggagtttgcagtcttagaaaaaaaaaactatgagtcttagatggcaggagcagcaaagccatcaagatgcacacattgcaaagtggcatgtgtacaggaatgggaggaactcatggccctgtttgcagtctccatggggctgagttgttccggttttatatttgagagaattccaactgctgcgtgaaaatggatttcaagggagacagaggggaggccggtgcagcagctcaggtgagagatgatgttggcgtggactgagatggttgcagtggatatggtgaggtgtgaatgggcttgagaggtattttgaagataaaatgagcaggaatttacatgagggttgggagtgaggtaaagagaatcaaaagtaattcctgggctgggcacagtggctcacacctgtaatcccagcactttgggaggccaagacaggtgaatcacgaggtcaggagatcaagaccatcctggctaacacagtgaaaccctgtctctactaaaaatacaaagaattagccgggtgtggtggcacgtgcctgtaatcccagctatttggaaggctgaggcaggcgaatggcttgaacctgggaggcggaggttgcagtgagccaagattgtgccactgcactccaggctgggcgtttgggagacagtgagtttgtgacacccaagagagaatgtcacagaagccattagatattccagactgactctcaaaggagaggtcagaatttggagattcaggagttctcagccaatacatggtgtttaaagctatagaattggatgttttcatcgaggaagagagcagagagagacaaaaagaggaatcaggacctgctgtattagttatctgtgtggcataagaaactgctgtcaacctcagtgtcttaaattttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggcctgtcttaaattttaaaatcatttattatgtcacacattttctgtggatctggagttctggagcagctgagctggacagctctgagtcagggttgcttgatgcaggttgccttcaagctgtcagctggggctgcaatgatttgaaggcttgactggggccggaggatccacttccaagctgccttattcatgtggttcttagctagaggcctctatcccctgctggctgtcggcaggagactttagttccttaccatgtgggcctctcaataggctgcttgggtttctttacagcatggctgctggctttccctgagcaagttattccagagaaagagaagacgcagaagccacaatgtcttttatgatctactgctggaagtcactctgccccatcattcattagaagtcatgaaatacagctgctattcaaggggaggagaattgggctccgctgaagggaggagtatatcaagtgatttgtaggtgtactttaaaactgtcgcagctgaaccaggcaaggtcacgtgcacttgtaattccagctagttgggaggctgaggcaggagaatcacttgagccccaggagttcgagaccagtctgggcaacatggtgagactctgtctctacaagaaagcacaaaaattagctggatgtagtagtacatgcctgtagacccagctactcaggaggctgaggcaggaggattgcttgagcctaggaggttgaggctgcagtgagtcgtcttctgggagacagagtgagaacctgtctcaaataatgataataataaaaacgtaactaccacatctatgcagaggttctcccacactaagcgggtatcagcgcagaggagtcagcaaagcccactgaggagtggccagtgaagtaggaagacccacatgttaggaggaaccgtgggaggattgggttttaaggagacagaatggtgtcagtgctgctgggagcttgagcaagccaggataagaaagtgtgccctcggctttctaccatggatgtcagcggtgacctcgccagaagcatttcactgcaacctggggcaaaagtcagattggaatggactgaagagtgcatgggaggagaggaatgaaggcggtgagtgtagatacctcttttgagaagggtagaggtgaacaaagaaggtggtggtggctgaagaaggatgtggggtgacaggaggaattgtttttggacaggagatgtacaaatgtgttctcatgctggtggaaacagtgcagtagaaagggggaatcgggggttcaggacagcgatgcagaggccacgaagacaggaggggcgtggttcaggcaggggccccgtagaaaacagaggacatcttcaaacaggggaaatggaagacggttcaataaagggactctttaccaagccacaggcaggatgcagggacatcccaaggcagagaggagtaccccaggcctgaagtcttgagatcacagggtcatgagagcagattcaggaacctggacagaggtggtcactgccagccgtgatgactcgcagagaggagctgagggaagtcagtccaacatcactgttgctctccctcctctcccgcccctgcttcctacttgcctaactttccgaagccagagggcatgagccccggggggtggagccagcaagtgagtttcctggggtgcagaacaacatggagaagggggaggagcacctagaaaggcaacctgaagagatgtggagacgtggcatggagcaggtgcagagggcacatggagggcttggccgtggggttaggacacgccctgcattggtccgcatcagcagtatggagcggttttgcagcattgaggtggggagtgtgggctttcatctctgaaagctgctatcttctgaacgaaccatgaggtgatgtcattggctgagagggagctggggaaaggatgtgagaagggtgagaagagaggatgaaaagatgcaattgtctccacagggagcaggaagcactcaagaaatataataggaccctgggcagcacggagtgccctcctgggctttgcggtcctgacattaaagtgtaaccagttggcctcattgtgagatcgcctccagctggcagacccagagaagtgcagaaggggctcatccaggcctggggtttgcaaagggaacacacaagtagaggagaagagaggagaacagggaagggatcagataccagattgctgcccaggcgcacacacaaacacggacatgcatagaaggccatcagcatttgcctacaaacataaacataggcatgaacataatagtgaacatgtctgaggcaaacatccagattcgcctgggcttaaactgcactcacatgtgtggtaatcccacaccacgtggacacagatgcccaggagagtgaatatccacatgcatataaacaatcggctgcatggatttgtgcaggcagacacagggcaaacatgcagtctatgcgggatacagacgcatgaagagatctgcacacagacctgagtaaagaactcatgtactgaaagcggcctgagttgacgtggagatacctgctgtgtctatgctcatttgcatgtggaaataagtagcttaatagagtggttacaaccacagaatctggaaccagatggcctaagttcaaatctaggctctgctctgacacatattagctgaggtttcactaagttacttaacctctctgtgcctcgattgcctcatctgtaaagtggggataataacatcacctttatagagttgttggaagatccagggaattataccacactgtcctggttcgcctcctatctcttgggctgcttcttctcatgtcccttgctggtttctccatgttgcccagtatctaaacctagtccctgggcctgttctctgatctgtctacccacactcccttgctggtatcatgcagtctgcagctggggacttacgtcacttgatcctttcactgtccgtcactcccatcacaatcgcacctccctccgtacctagtggtgattccctggttcatcattaggagaactttcgtgcctgcacattcaactccctggccctccatacttgctttgcaaaacctcaaaccttgttgaacccagctctccacctactcagcgccttcacctgtgaagctatatgtggctggagaaacacacaggatgctggcaggactcactttgtattcatgactgcaagccttaggtgacctcaatgctgccccaagcctccccccttcactctctagatgactcctttatgccttcttcctcctccgccctccagccacctcccccacatcctcactcagaactgatcactttaggttagtgcaaaaataattgtggttttggccattaaaagtaatggcaatatatcactgagaaaatcaaagcattagaaagagatcttcacagctctgatccccacaacgacccacccactgtatatcatcaattctaagatgcatctttgttagaccacatcttagcatctctgaaactggaatgtttattccagtcaatagtttaattctcctttcttacttttggataagtgtcttatatttaatagtaacttagatttgatgaaatacggtagtatatatgccctcttgttaccaagggatggactgttcttgtccttgtccaaggatggaagggattgtcctttaaaaccaatcccttccctagtgcaccagatcccatccactctcatccctgtaagaacaccacatccgtaattctatccactcttccccatagaatctttcccttctctgtggcatcatccacaaacacatgctattttattcctcccaacttatgaaaatgctcttgacttgtctctcactactggcccatcctccccattctagcaaaattctgtggcagaatgatctttgttcaccatctccaattcctctcctccctttctctttgaactccctccaaaccagcttttaagtcagcattctactccagctgctcttgccagggtcgccagtcggtaaacgcagtcaccagttctcaggcctcctatttgacctcaacacagcatgtgaacacagctgagcactgtctcctcttcggaaccctgtcctaagttgacttgctggacaccacactctcctggttcttctcctacctgaaaggcggctccttcttatcatctttgctggtttctcttggtgtcaatatttaaagtttgcagagggaccccgggttcagtcccttgccctatttccaagtctggctacactgatactgtccactctcctggctttaaataccacctccacattgatggtgcttctctgagcctggaacctgcatcactaactcccaactcattatctcccctcgggggcccatcaggtgtcttctttgtttgtttgtttgtttgttagtttttgagacagggtctctctgtcacccaggctggagtgcggtggtgtgaaaaaggctcactgcaacctcgaccttccgggctcgagccatcctcctgcctcagcctccctagtagctgggaccacaggcgcacatgctaccgattcagctatttttaaatttttctgtagagaggagggtctcgccatgttgcccaggctggtctcaaactcctgtgctcaagcaatcctcctgccttagcctcctaaagtaagggagagagatgtgagccactgcacccagcctcatcaggtgccttgaagattacctattcaaggataaccttctgatgagagccttcattacactttacccctttccctgtgactatgagcctcttgaggggagacattgtattgtgtcgtgtcttcatgcccagcacatactgccaggtaaccacttgctaaatgaatgaatccgtgaccaagaagatgtagagcagaaggagggggctcaggttttgacggtagggagcactggactcatggaattcctgaactgaaaggaacaacctgttcaaaggtgcgggggcaagcctcccaggaaagcagccatcacaggaagggaagggagaggggagagcattccgggcatggggtacagcagagacaaaggcccggaggctgaagtggcagcttgttggggaagacagtggaccaatgggcaattcatgaggagtcaagattatagacatattaaagctaaactcactcttgaaagggcttaacgtctaggcacaggaacttggacattaaggtgtagtcagtgggggagaattaaagatttttgagcaaagaggagatgtaagagaccaaagatgctccagaatttcaggtcaaaacaactaggagaaaatattgcacaaacaagtgttttctaaaaatgcaggctaattttttctttcttaatcccaaatgcaatagtcaagctaaatttagatgacacaaaaacatggtgataaataatgtaaaaccacgttgtgtgagttatcctcttttgattacatcaaagaaagagtattagtaagatgttagtgcttaacccctttataatatgtgtttaacatctgcccctttcttaaaatcaaaatgaggccaggtgtggtggctcacacctgtaatcccagcactttgggatgccgaggcaggcggatcatctaaggtcaggatttcaagaccagcctggccaacgtggcaaaaccccatctctagtaaaaataccaaaaaaaaaaaaaaataatagccaggcatgatggtgcatacctgtagtcccagctacttggaatgctgaggcagaagaattgtttgaaccctggaggtggaggttgcagtgagccaagattgcaccactgcactgcagcctgggtgacagagcgagactttgtcaaaaagaaagaaagaaagaaggaaaggaaggaaggaaggaaggaaggaaggaaaagaaaagaaagggaaagaaaaaagaaaaagaaagaaagaaagaaagaaagaaagaaagaaagaaagaaagaaagaaagaaaaagaaaggcagaaagcaagcaagcagggagggagggaagaaagaaagaagccagtcttgggagcagatactttgacgggcagtattatccagctggaatttaattgcatttgttttgtttttgttatgtttacttttaccattgcagatagtttatagtgaatcatttaatactactgttaatgatacagtttattttttcattcatcaatcattcagtaaagatttattgagcacctattgtatgccaggcacagttctagatgcagaggatgtagccacagacaagacagaccaaaatccctgccctcgtggcgtttccactctagtagaggacagcagacaataaacaaaatgagaatgtcaagtagatggtgcaatgtggcgctgtgttctatggaggaaaacaaagcaggagaggggagagtgactgctgggtaaggtcttcctccacctcctttgcatctttgctcacatgccagcttctcctgggcttcacagaccaccaatttataatttccatttaaaacttccattttatttttttaatttttatttatttatttatttatttcgagatggggtttcgctcttgttgcccagggtggagtgcagtggcacaatcttggctcactgcaacttccgcctcccgggttcaagcaattctcgtgcctcagcctcctgagaagctgggattacaggtaaccgccaccatgcctggctaatttttgtatttttagtagagccaccccggcctcccaaagtgctgggattacaggcgtgagccacggcgcccagccaaaacttccgttttaaattggcagtctgggaagcccaggagaaaatggcatgtgagcaaagatgtgaaggaggcagaggaatgagctctgaggctgtgcaggagaagattgaggcagggggaacagcgagggcaaaggccctgtggtaggaatgtccctgatgtgaggagttgcaggagtccaatgtggctggagaagagtgaggaagcgggagagaagcagactctgaggtctgaaaggtacctgggggctggatcacacagggccttacagggcttgggagggtttccgcttttactctggccacaacagtgcatcatcattagaggattctgagaagggagaagtgacattctccgacatttaaactttaacatgaccactttggctgctgtgctaagaatagactctaggggacaagggcagaaacagggaaaccttttaaaaggacattgtgataacttagaagataatggttgtttggacaaggacggtacaagtagaggcagtatcagattctggaagatatccaaagttatctgaagacaatgctgatggaaattgctgacaaattgtatgtgggggtgaaaaagaattcatggtggggccgggcgcagtggcttatgcctgtaatcccagcactttgggagaccgaggtgggcggatcacctgaggtcaggagttcaagaccagcctggccaacattgtgaaaccctgtttctactaaaaatacaaaaattagccaagcatggtggtgcacacctgtaatcccagctattagggaggctgaagcgggagaattgcttgaacctgggaggtagaagttgcagtgagcttagattgtgccactgcactccagcctgggcaacagagtgagactccatctcaaaaaaaaaaaaaaaaaagaaaaagaaagaaagagaattaatggtggttccgaggcttttgggcggagcaactgcaagggtggaggttccattactgagatggggatgagcatggtggctctggggggaattccattttgagtttgaaatgcagagcagacaccaagtggaactgtcaaaggagtagttgtatatgtgtctggagtttcatgacacatatttgcactttatttatttatttatttgagacagagtctcactctgtcacctaggctagagtgcagtggcactgtcttggctcactgcagcctccatctcccaggttgaggcaattctcctgccttagcctcctcagtagctgggattacaggtgtgcaccaccacacccagctaatttttatatttttagtagagatggggtttcaccatagtggccaggctggtcttgaactcctgacctcaaatgatctgctcaccttggcctcccaaagtgctgggattacaggtgtgaaccaccatgcctggccacgtatttgcactttaaaagtcagctgatgtatcagctgtaaaatgaggataagaaaacaaaagaataaaaaaaaagaaaaacagtcgatttaaacaaaaaaataataatagaagtagcatgaggatatggcaaaaatcactgaagttgtacaggaatgagtaaccctcagaaaatactggggcaggcatgcagaagccagtggagctcatggagagaagcaagtgtgtgtgttaggggaggctgatccccttgcctcctctttcttccactctagggcagaaatgcgagctgtggctctgtggctgtgccttcaccctcgctgatgtcctcctgggagccaccctgcaccgcctcaagttcctgggactgtccaagaaatactgggaagatggcagccggcccaacctgcagtccttctttgagagggtccagagacgctttgccttccggaaagtcctgggtgacatccacaccaccctgctgtcggccgtcatccccaatgctttccggctggtcaagaggaaacccccatccttcttcggggcgtccttcctcatgggctccctgggtgggatgggctactttgcctactggtacctcaagaaaaaatacatctagggccaggcctggggcttggtgtctgactgtcggtgtctctgtgctgtgtgattccccgtgagctctcagtaactcactgtctcatgaacacttggacagccctccccgcccttcgttctgagtaataataccgtcagtgtgaaaacattccgtagtttagaagtagacgttgccaatgctgtgactcaaggccacggctctactaaaagagagagaggaagcgagagagagagagaaaaaacaaaaaacagaaaacacgaatgccttttctatcgattcaaggtctcaagatggaactgtggagactggttaggatctgaggtgagtcccaggatgtttcgtccaccagggcccagattctgggaggtgctggggactcagagggcctgacccctcacctccccttccctcttgcccagggaactcttccacaggacaaagccgacatcaagactcaactcctctaaccggtacctctgaatggggctggataaccggagaccccatgggaggtccctgaagatcagaaggggcttcacgcttctcctggacatggactagcttgagccaaggcagtggcacccaaaaaccaggctgcagtggggacggataccatgagcacaccctctcattgtccttctgatttggtccatgtgttgggtttggccttagtagaaatctctgaaggcagcagccatcatcctcttcctaccttgagtttttctaccctgtgaggtgggactttcagtaaaagccatgttgaccctctctcagaaggtcagtccagcccaagtgcaggggcggatctggaggtggacaaacctaggtccccctcctagcctctgtccaagccatctccttcaatatcccccccttcctgtcactcccggggctgtccctgtactacacggtgccatggagccggggagagcggggaagtctctgcatccatgccacccaccccagtcgggtctcactttcctgtgccttttgcatgttgggaaagggtcttggtgtcactgccgctcatgcatagaaaccaccaaaagccccaataaagcatccaggaggaacagttgcttttcatttctaaacctgtgctgtccatctagttctcattgccaagtgctggagccagaagggtagagatgtgaggtttcagtctcagttcttcacaagagcaagcaagagttgactgcctgtctcaagttgctgggtctggggctggcttccagactgactttccagggctctgaccttaacatcaacccagctcatttaggctcagccctttacaggttacagggcatgtgtacaaccctttgttctcattaacctgtgcaagggccaggtgtagtgactcatatttataatcccagtgctttgggaggccaaggcgggagaattgctccaggccaggagttcaagacaagcctgggcaatatagcgagaccccatctctagaaaataaaataaaataaacctatatatggacctcagggggcacccagggcacatgccccccaccccaatttcccagagggaaaaatgtatttaaaatgcccaaagaacattaaatcaggagtataatgtgtagaatataaggcatggttttacttattttgcaataaaaaaaagtattaagaatttgcacatcttttttcatcaaggtaaaaagaaagcttagtcatccagggccaagacagggcaaaggtggaacttagagaccatgaacactgtctggcaccatccatccccttggctaatcaaccattcacacaggctgggtgtgggctcacgcctgtgatcccagcactttgggagcccaaggcgggtggatcacgaggtcaggagttcaagaccagcctggccaacgtggtgaaacctcgtctctacaaagaatacaaaaattagctgggtgtggtggcgcatgcctgtaatcccagctactcaggaggctgaggcacaagaatcgcttgaacccaggaggcagaggttgcagtaagccaagatggcaccactgcattccagcctagcaacagagcgagactccatctcaaaaaaaaaaaaaaaaaaaatcaaacatccacacagactctccccattcttcattcaacttccactcaagaacaacaatataatactcaatccccacaggatttactgcctcctgcaatgaggacgtgctaaacctctctccaaaaatgagactcacaaagccccatcggtcagtaacatcactctggataacggtggattctcttctcattcctcctctagctctagagatcacacccacacctcaatctactataatattcagatgaaaacataaatttgaccatcactagcattccttatattcaattacacacacacacacacacacacacacacacacaccccaagcaaagaaaatactcagaactgctataggtctcatttctgtaattgattccaaggccactgttgatatttacagtttctcttttttcactagctattctaggttctctttgccctcagccagcacctcagttagttagcgtatttaacctggtgacatgactcagactctggtggtccttagattgctatggtcttccattactattggatgtggaagtattatggggcactgcagacaatcccctattcttccatgctatcattgtgcaggagcaacccagtttagccctggtaatcagctcaattaccccagcctgtagagaaacacactactttgcctgtagtttcaagggtatgaggagctcaaaatggccaagtggcagtctcaacttctaacttaattgaaccattgaattattcctcaatagatgtactcctcccttaggagctataatttctaagctatcaaaatccacagtgtcagggatgggaagcaacagttttatgaatgggttatttgtataatagtgagagtcacttccacttccaccttggcattgttagacccgtgttctctggcagtgggagaaacagcactgtggttggttcaaagtacatactgtatcctgtaggacagcactccacattgcagtgtctcctggctgccactgtaccagtcttcaagagaccatttcagtgttcgataagaccagctgcttctagataagagagtactttcttctagataagagagtacatggtaaggccacaatatcccatgggtataaccacattgctgaatttcttttgcgataatatcaactctttggtcagaagcaatgttatgtgcaataccaacactggaaccaaggcattcataagtccatggatatagtggtcggagaaggcaaacccatagagagaataagtgagtacaaactgctgcttcctctgtgatggaaggggttcaatatgatctatctgccctcagagagctggttcctatggcgaatggtgtcatattaggaactgtgcacacggggcactctgcagtggcattcactaaatcagtcttaatcagaggaagtccgtgttgttgtatccatctataacctctagctcaattaccatggcccttttgtacatcagcctattgagcaagcactggagtggctggggaaagagaatgacagacagctacagaacaaggcatcttgtccattggtttcttgaacaatggtttcctctgcagtgggtactgtttgagggaacatgtgcataggacacaaatatcctcccattctgtgtccactgttaggggtccatccacattccttctcccacagagctcctggttaccaatcttccagtcttctttccatgttcataagcatccggccaaaccatccgtcccatgaatatgtacagatttatattcctggacttctgtctctatcttgatagggcagacaagcagacatactgcttgaaattctgttcactgcgaggatttgccttctgcaatgtctttcggggaattcctgtagtgctgcaaccatccacttccaggtggtgccaggcctgagtctttcttcctccatcaactgattatagggcatttgccaagaggcctctggtgttgactgaggaagaggcagcaatgtggtgaaatagatgccatcgtctgagctgtatcactttcacttgatgatagaatgatgctgccatatatgcctagctttatggcttgatggatcagatgataccaagttcatgatggggagatcaggttgcatagtcacctggtgtctcctggtcaggcgtgtagtctttaccagggcccagtagaaagccagatgttatttctcaaaaggaccattattgtttgcagaagaggacatgactttgtcccaaaccctagggatgtgcactgagattttcctattagggcttgctggaagctccatactggatgcctatgtcatatgtgatttaaataccactggatctgctgggtcataaggctgaactcgcagagcatcttatactgtagcctgaatttgctttgggatccattctaaactggcagtcttatgggttactcagtaaatggtttggagcagtgtacacaaatggatgtattgccaggtacagtggcacatgcctgtaatcccagctacttgagaggctgaggcaggaggatcacttgagctcaggagtttgagaccagactgggcaatttagtgagacccccatcaaaaacaaagacaaaaataagaacaaatgggtgtatgttgcctcccaaatccaaagagggccaccaattgtgcctttttcttagtaggaggtgcagcaacttatctttcacttggaggggatatcctgacatttcctagatccctgggttgctaaaaactttaccaggtttccagaactctgaatgttcatggggtttacataccaccctctggcatgcctgggtcttagtgaatcatctggtgtacttgatgcgtcctgctcattagttacagcatgatgtcatcaatgtagaggatcaatgttttgttacagataatcaagataatcaaggtctctacacactagattatgacagaaaaagaaaagctgacatagtcccatggaagaaagtgatatgctactgccctgccaattaaggcaaatgaggctgggcatggtggctcacacctgtaatcccagcactttgggaagccgaggcgggtggatcacctgaggtcaggagttcacgaccagcctgacaaatatggtaaaaccccatctctactaaaaatacaaaaattatctgggtgtggtggcgtgtgcctctaatcccagctgctcgagaggctgagacaggagaattgcttgaacttgggagttggaggttgcagtgagccgagattgcgccactgcactccagcctcagtgacagggcaaaactccatctcaaaaaaaaaaaaaaatgacttttggtgattcttatcaatttgatatacagaataaacattttctagaccaagagctggatacaaagtgctaaatactgtgttgatttgcattaataaagaaaccacatctgaaaaaactgcggtttgaattaccacctgagggggttcacagtaaaaccttatccttcttctgaacccatcccttttacagtattgcttttagtttactagtctagtgtgtgaggtggtggtggtgtgaagttccaggagctttctcttcgtccttttacctaagtagtcctcattccatgggtcaaggagtcctgtgtaggctccactagctgttaaatttgtttgttccaataacatattcaggacctgggttaaaaatcacagatgggtccacagagccactggtccactcgctatgagatgttttcaaaccaaaactccatttatcacctaatcccaataagcctcattaaaaattatttgttaatttatttacttttacatttctgtggtatatatggggtacatgagacactttgatacaggaatacaatgcataataatcataacagggtaaatggggtatctatcacctcaagaatttatcctttctttgtgttacaaacaatccaattatactcttcagttttttgtttgagatggagtctcgctttgttacccaggctggagtgcgtgacacgatctcggctcactctgcctcccaggttcaagtgattctcctgcctcagcctcccaagtagctgggactacaggcacgtgccaccacacctggctaattttttgtattttcagtagagacgggtttcaccactttggccaggctggtctcgaacttctgacctcaagtgatctccccacctcatcctcccaaagtgctaggattacaggcatgagccactgtgcctggcctctttagtatttttgttttaaaattttgtttgtagagacaaagtctcactatgttgccccagctggtttcaaactcctacactcaagcaatcctcctgccttggctcccccaaattttgggattacaggcgtgagccaccatgcgcagccttttagtgttgacacccttgttgaaaattagttcagtgtagacatactgatttaattctgggttctctattctttcccattggtctatctgtctgtttttatgccagtactatgctgttttggttacagtataatttgaagccaggtaatgtgatttctccagttttattctttagctttggctattctggatctttcatggttctatataaattttaggattattttttatatttctgtgaagaatgtaattggtattttgatagggattgcactgaatctgtagattgctttgggtagtatggacatttaaacagtattaattcttccaatccatgaacatggagtatctttccctttttttggtatgtcctcttcaacttcttacatcaatgttttgtagttttcattatagagatctttcacttctttggttaaattaatttttaggtttttattttacttgtagctattgtaaatgagattattttcttgatttcttttgcagattgtttgctgttggcatacagaaatgccactgatttttgtacattgattttgcatcctgcaacttatcagttctaaatttatcagttctaagagatttttggtgaagtcttttgttttttccaaatataaggtcatattatctgcaaacaaggataatttgacttcttcctttccaatttggatgctcattacgtctctcttttgtctaactgctctagctaggacttccagtactatgttgtataacagtggtgaaagtgggcacccttgtcttcttctagatcttaaaagaaaggctttcagtttttccccattcagtatgatactggctgtgcgtctgccatacatggcttttattgtcttgagatatgttccttctatcctgttttttgagttttttttatcatgaagggttgttgaatttttcaaatgctttttcagcatgaattgaaattatcatgtggtttttctccttcattctattgatataatgtatcacactgattgatttgcatatgctgaaccatccttgcatccctgggataaatcccacttggtcatgattaatgatctttttaatgtgttgttggattctttttgctagtattttgttgaggatttttacatcaatgttcatcagggatattgacctgtagttttctttcttttttttttttaatgtgtctttgtctggttttggtatcagggtaatactgacctcatagaatgagtttggaaataagccctgcttgtgattatagtagcattttgggtccccagggaatagcttcaaatcagagccagtgtagaatataccttgaaagctctgggtatttccctctttcttgaaatttcttccttttctctgggatacactcaggtaagtgttaggctcctctgaagagcttaaaggaaaatagtttatacttgtgacagtcacaggaacttttctcaaggagatctagccttccctacatttcatgggccccagggcactgaactgggtaagagattacttctgcaggacagttctctgggtgtccttggactgatccagttctccccactttcttgtttacaattctctaaaacaacagtagaatgtgctggaatgtaatatcttgacataggaagggactagccagaacttcctgggctctgttccaatccccccaaagcccgccccgaacaggatgtccttcagtgctttagcccagtgatcacattgccctgggtcataaaacccaagccaagctacttccagggtcccactgctgcagtgcaagtgaggcatacacagtcaaggcattatccaccttgggcagcattcctgaggcttgggggaccaggcttctgttgtcctttgctcctatctgtaagtaataaatctgcttcatgtaacttgtgaatatgagtgttctgtcccaccggactcagacaagttggtagccagtgcatggtgagcctgtttcaccactttattagtctgttttcatactgctgataaagacatagccaagactgggcaatttacaaaggaaagagatttaattggactaacagttccacgtggctggagaaacctcataatcatggtggaaggcaaggaggagcaagtcatgtcttacatggatggcagcaggcaaagagagagcttgtgcagggagactccagcttttcaaagccatcaaatcttgtaagacttactatcacaagaacagcatgggaaggaactgcctccatgattcaattagctcccactgggtccctcccacaacacgtgggaattcaaaatgagattatggtggggacacagccaaaccatgtctccacttaaagttaggtctctgctcactggacccaaagtttttctgactatacagagcaagtaagacttaaactgctcaaatgtttgatttctagggacaatatgatgaattcacctccagtaaaagtccctgtgggtcaaaatattccagtggttgctatggctctgctgctatgatggagtttgcacccaactcatctctggcagtaagtgctgccacttagactctgccactcctcatcaaaaccaggaagcccatttcagtggtggcacttcccactgtcacacctaggctatagaggaaagtactccagggcttttgaatggtactagtgctttctctgccagtgcttgctcagtgacttagtgaaaggagtgtcctctgggcccccctggtggacttaaatgatagggttatttaaggtgatagggtcagggtcaagtcatacataacaactggctgtggtggggcacctgtaatcctagctacttgggaggctgagatgcgaggaccaatcgagcccaggagtttcagatcagcctgcgcaacatagtgagaccctgtctcaaaacaaattaaaattaaaattaaaaaagaaagatgtcaccccatgatattttaaaaaaccgtacatagtaaatccatcccaacatttctatttccttaaaacttcgaattcctcccttaatagtatcttagggaaattctagcatctcaacttcaatgaatgtagaccaccactaagtccaggtttcagtcagtcaatccaggaaaccattagagtcactcgcaaatgctgagataacatattaaatctagactctccagaaaatgcatgaatatccataaatttaacccagcctaatatggtttgttcttcttggtctggcatctttatgttccattgccacacatactcccccaggtctctgtcaacatacatcaacaaaacatttttattctttggtatcatagactctctttgggtcagactttgaacttgctctcctggggtgtgtaagggtctggaagcagtgaagggtgctggagttggccttgaggtgaggcacccccttgcaggaaactgtcttggatgaggtcattacgagtcttccagcaagagaatgatcttctcagaagaggaggagggctgcttccactgttaaagaggacctgggttgatttggaggttcaaggttggcagattcatctgattttacccacaggggtccaaactgtatgtgaataatggaatggagcccatgagcctgccattgctactgaatgactgggggcactgctgtcgctactgaagctcatgttacttcactgctgctgctgaaaaaaaaaaaaacagaaacccccactcctgctgattgctaaaatgcttttcatgttgttagagcccaggatcatctatagtcaccttcagtcacccactgccactgtcagagcccatttctagaatcagagaaaaaattaaaaatgtcctcgtttcctccacctcccaatctccaccagtgtcttccactagcagagcccagaggaaagcaggatgagaaatgcacaatgcaggcttcccatcctggggatacagaggagcacgtggaggggaagggtggaggtcagagtcaacgggcatcgcccaggacactaaccctgctgaacttcaggtccctcgcctcaaatacaaagttaaaaattcaccccctacttacctctgcagattatgttgaggaactaagataatgattgtgagattactttataaattaatcaagtgctgtacatttgcaatagaatgttattattccagttattattacagttgcatgggttatttatattgttgttgtaataggtactgggactgccacccttgctcccccagtggctgggaggattggctgttaatggctcacagctgagtccctcttggggcactgcctcagctgaagggagctgtctcattcaaggttactccagttccctaagggtagcttacatccagcgactggtaggtacagagatagaaaggtctgaccctccttacttcaatttaggacatctctgaagggccatccgagacccacaactctccacaggatcagctaaggttctggaacaactgcatcatagttcaacttctctctctgcccttccctgcttgtctcactcccttgcaggtgatgtttccaagagcacttcccaataaaccttctaaatgtaaatctcatctcagagtctgtttctgaggaaaccatgctaaagcaattatcgtggtgctttcaagtaccatcacaaacatctgacccttaagaccaccctaagatgcagaaagggcacagagtgttacacatactccttgttcagatgaagaagttgaggctcagtgagattaagtagctcacccaaggttgcacacaaagtcaaggtggagtcagatctgagcacagctctcttgactctctgacaggtgttttgaccatttcacttccagggagaaagcacagatgcctgtttggggggtcccaaggattagagctgggaggatgcttccagtcagcctcttctgtctgctggagcagaagcagattagtgttgccctgggctcgggatccctagcaggaggacaaggaggagaatccatttacaaacactccggaagcacctaccctgggccagagtcattaaataggacccagtccccacccccagggagcctccagctttggggctgaagaagagagcaatattgcttgaaggtaaggggaactctggaagcaggatggaaagcaattttggccagaacaataagtgaaagactgatcagcaggaagagtctgctgagatttggggatgactgcccacagcaaagacagagaaactcccatctcggtttggagacagggagggtcttcagttgttagaagagctggcaactcttcctagaatctgtggaaagactgttgcccaaatgagctgtctccaataaatggccaacacacagtagcttttctaaggatatctgcatgaagagaatgaggaaccccagcttggagaagtgggaataaaggagatggaatacaggggctgggaagtgcagaatcattagggtgaacgctgagctgttttaacaagagggaagaaacacctggagcttaagagcgtaaaagttcaggtatggtggctcacacctgtaatcctagcactttgggaggccgagataggcagatcatgaggtcaggagttgagaccagccaacatggtgaaaccctgtctctactaaaaatacaacaattagccgggcatggtgggagtcacctgtaatcccagctactcgggaggctgaggcagaagaactgcttgaacctgggaggcggaggttgcagtgagctgagatggcgccactgtactccagcttgggcaacagagcaagactccatctcaaaaaaaaaaaagagagtaaaagttcagttatcttggggaggctgaggcaggaggatcgcttaagcccaggagttcaaatccagcctggaaaacaaagtgaaaccccatcactaaaatctttaaaaggggtaggggaagttcagttatctcccattaacaagttcagtggtgcagactggccggtgtctgtttgctgactgttactccaccttccagtgcattgtcttcatctgcatggtcaaaactcgatcatgagaagccgggttttatgtgataggacaggaaagagacgatggaggaacatatgcccaatagtttaaggcctagacttgaaagagcaacatatcacttccgctcacattccaatggtaagaatggagggcctcacccagctgcaaaggaggctgggaaatgtagtatctggctgggtagtctattgctaaggaagaagagaacagattttcctggacagctagcagcctctggcataaggaataactgtgaatgagaagaagatcaggtagactgctggagaaaatggcagactctggctgggcgcggtggctcacacctgtaatcccagcacgttgggaggccaagatgggtggatcacctgaggtcaggagtttgagaccaacctggccaacatagtaaaaccctgtctctactaaaaatacaagttagccaggcatggtggtgcccgcctgtaatcccagctactagggggaggctgaagcaggagaattgcttgaactgggaggcggaggttgcagtgagccgagattgcgccactgcactccagcctgggcaacaagagggagactttgtcttgaaagaaagaaagagagagagggagggaggaaggaaggaaggaaggaaggagaaagagagaaacagagagagagaagggagggagggagggaggaaggaaagaagaaaggaaggagggaaggggagagagagagaaaagaggagaggagaggagaggaggagaaagaaagaaaatggcagactcggtatgggctggaagacattggaaacccctcacccacctgttctacatatgggacaccaaggccctgcatggggtgatgtctggtttggtcaggatcccactgtaagaggactagagccctaggagtcctttccctggtcccattatttttatttttatttttagagacagagtctcactctgttgttgcccaggctggagtgcagtggtgagatcatagctcactgcagcctcaaactcctgggctcaagtgatcctcccatctcagcctcctgagttgctggaactacaggcgtgcaccaccatgcctggctcctggtcccattctgtctctcagaacatcatggagaaaatccagagtgggagacaggaagtgtcaatacataggcatttacccagaaatctgtcagctgcccagccttctatgagttgccatcaggtgcttcagaaatgaagacgacggtggctatcagagttcagtagtctgatggacaacactgccaggactgtggtagtaggtgtccccaaagtttagactgttaagaaaggtctctccatcattacaggattcctgctggggaggacagtaagggcttctaaagggcatattttctttagctcattggttcctcactgccaaagtcacagactcaattgcctagatcacatcagcttatctccaaagacctgtttggttcctttctagcaacctacattacctaaaggccttagttttctcatctctgaaatggagctgataataatagcttccattcattgactactaactatgcactctgaaatttacataaattatttctaaccctgagaagtgcagtttttatgtttcatggatgagaaaactgaggctcagagagttcaagtactgaaggtaaaggcagtagattagactattcgtcttccccaattggattgtacattcctggcctttgacatgaaactttgcaggacctcccactgtcggtagagtttattccctgccccattgatgcgcccacagaaggttagaggaaggatgtgtcaggagcagaggccttattttatttatttatgtatgtatgtattgagatggagttttgctcttgttgcccaggctggaatgcggtggcacgatcttggctcactgcagcctctgtctcttgggttcaagtgactctcctacctcagcctccccagtagctgggattacaggcacacaccaccatgactagctaattttttgtatttttagtagagacggggtttcaccaatgttgaccaggctggtttcaaactcctggcctcaggtgctctgcccaccttggcctcccaaagtgctgggattacaggcatgagccagcgcgcccagccaagcagaggctttaaatgtgctgtatggtttggccaaggtttgggtgcctcagtggtcttgatgagaagagcatgcccccatacagttgctgccctttaagcctggacaccagaatgaaacaagtggaacagcagagcccagctgtggcctggagccaagtgtagccaatgggcagcctgatgcggaactcaccagctgaggccagcccataccagcagagctgcagttgatctgtgagcatttgtaagcctgtgagtttggaggtggcttgttgtaaagcattattgtaaccacccaatgggttcaccttacccactacctagacacacccaatgtatcaagacagaagaattgcaatgaagagagggtaattcacctagagccagctgtgcaggagaccggagttttattattactcaaatcggtctctccaagtattcagggatcagagtttttaaaaataatttgggttgctgggtgcagtggctcacatctataatcctagcgctttgggaggccgaggcgggtggatcaccttgaggtcaggagttcgagaccagcctggccaacatggtgaaaccccatctctactaaaaatacaaaaattagccgggtgtggtggcacgtgcctgtagtcccagctacatgggaggctgagagaggagagtcgcttgaacccaggaggcggaggttgcagtgagctgaggtcacactgttgcactccagcctgagtgacagagtgagattccatctcaaaaaaataaagtaaaaaataaataagaaaaataaaaataatttggcaggcaggggcttgggaagtggggagtgctgatgggtcaggttggagatggaatcatagggggttgaagtaaggttttcttgctgtcttctgttcctgggttgaatggcagaactggttgagcccagttaccggtctggttagtgtcagctgatccatggagtgcaggatttgcaaaatatctcaagcactgatcttaggttttacagcagtgttgttatccccaggagcaatttgggggtgttcagattcttggagccagggactgcatgacccctgaagtgtaatttctaatcttgtagctaatttgttagtcctgcaaaggcagactggccctcaggcaagaagagggtctttttgggaaacggctattatcaattttgtttccgagtcaaaccatgaactgagttcctttccaaagttagtttggcctacacccaggaatgaacaaggacagcttaaaggttagatgcaagatggagtcggttaggtctgatttctttcactgtcataatttcctactataattttgcaaaggcggtttcattattacagcaatctctaatacaatggcagagctgggatatgaagcatcagatgtgttaggagccaaagcctttgctattttctctatggtgtaggttgttggtaactacaggtgagaaaatacagtaaaaatgtcagaccctaaataaaaaaatgaggaacaaatgcttgttattaatgttattcatggttgctttattattatattgatgatactaagtcatttcagggttgttgggggatatttaggaactatagtgcccaggcttctgagagagacatccttaggcaaaaatataatattacgtagcccccataggtgcctgacattttaaaacttatattttccaacccgtgacttcattaaggcaattaaagatggccaggcacggtggctcacgcctgtaatcgcagcactttgggaggccgaggcgggcagatcacctgaggtcgggagtttgagatcagcccgaccaaaatggagaaaccctgtctgtactaaaaatacaaaattactcgggcgtagtggtgcatgcctataatcccagctactcaggaggctgaggcaggagaactgcttgaacccaggaggcagaggttgtggtgagccaagatcgcgccgttgcactctagcctgggcaacaagagcaaaactccgtctcaaaaaaataaataaataaaataaaaaagacaattaaagactagtgtggcagaaagtattatcctcacttcgtagttgagtaaccagctcagaaaaacgaagtgatttgcccaagatcatacagctgaggagctgattggcagatctggaacgcggtctgcttggctccaggtcgagtgcttctaataactccagaagagagtccacttatgtccccatccattcaccccataccactcccatcagcacggcggggggtgtgcctggcagatggagcatgatcaggaaatgcaggcagaaggcaggaagggctgagaggagtggagggtggaaaattaactacagcagcttgttagggcagggccccaataactttttctttttcttttttttttttgagatggagtctcactctgtagcccaggctacagtgcagtggtgccatctctggtcactgcaacctctgtctcccgggttcaagcgattctcctgcctcagcctcctgagtagctgggattacaggcaggtaccactgtgcctggctaatttttgtatttttagtagagatggggtttcaccatgttggccaggctggtcttgaactcctgccctcaagtgatccgcccacctcaacctcccaaaatgctgggattacaggtgtgagccactgcacccgacccccaataactttagaaattaacaggctaaccagaggtggctcccaggctcccacccacctacctcctaggcactcccacaccccagatgcacatgccctgggcagccacaccctgacagagaagacatggcaagtggcagggctcagtgagaaggcccccagcctggtccccaaaactaagcagcccaggaactagtgccaggcagcccttagctcacctttgggcagatagcacctcaaataagatggggacctacttaaccttagccaaaaggacaccacagacacaatgtgccctttctttttacagctctcctaaaaaacagttcttattctccctcatcccctagtgaaccctgaaaccagactgcagaggctggagcacggggacccggccttccacattcactaactgcacttttttctttttttgagacagggtctcgctctgtcacccaggctggagtgcaatggtgcagtcttggctccctgcagtctcccgagtaactgggaccacaggcgcataccaccatgtccggctaattttttttttttatttttagtagagacagggttttgccatgttgcccaggttggtctcaaactcctgagctcaagcgatccgccctccttgacctcccaaagtgctgggattacaggcatgagccactgagcctaccctgatggtatattttgactacccatgagtcaataaaaatttaaaagtcacatgcatgggttttttccccctgattttaaagtaagttatggttctgctggcacatcagagatttactgtgcacttgaaagacatttatatagtacctcccacgtgctagttcctgttctttttattttattttatttatttattttttgagaccgagtctcaccgtgttgcccaggctggagtgcactggtgtaatcttggctcactgtaacctctgcctcctgggttcaagtgattctcctgcctcagcctgctgagtagctgggactaaaggcacccaccaccacgcccggctattttttttttttttttttttgtatttttagtaaaaatggggtttctccatgttggccaggctggtctcaaactcctgacctcaaatgatccgcccacctcagcctccaaaagtgctgggattacaggcatgagccaccatgcccggcctcactagttcctgttctgagtacaagtgttaattcatttagttctcacaaccctttaaggtaagttcttatacccattttacagatgaggaaactgtggcccagagaggtcaaggaacttgttaaggaacagccagagtgtgacagagtaaggatttaaactaacgcagtccatgataatctctccattcctttgcttttctaaatgctttatataaaccatctctgcctgagctggtgacagtgtcagggtagattcggaaaacaccctgcttttgaccctcagcacactttggggactctcctttcactgtctatgcccagctagactgtagacctgctgagggcaggtctgtgtctctctgagttaatggtgcatcccctgtgcctagtactgagcctggtatacctggtgctcctcagctgttggggcagtgaatgctgagtaagttgaggcactattaaccccaccacatgcttcagaaactgatgctcagagacattgacttggtcaagaacacacggctgtgagttatagccaacatgagcctgtggctttctacctccaggttctacactagacatataccacttattctttttattcctcctcgccttctttgtggtggtgagatcacttattctttgcagtgactgcatttatcactaaaatggagttgctataaccgatgggcatttaggttcttgataatctttcactcttacagacagctgtaatgaaaccttcgtccttagctttgctcacttcttgaagcatttctaaagcccaaatccctagattgaaatcactgggtctacacattttaagtgttttttgttttgtttcgttttgtttttgagagggagtctcactctatttctcaggctggagtgcagcggcacgatctcggctcactgccacctctgcctcctgggttcaagtgattctcctgcctcagcctcccaagtagttgggattacaggcgcacggcaccacgcccggctaatttttgtatttttagtagagacagggcttcaccatattggccaggctggtctcaaactcctgatctcaggtgatctgcccacctcggcctcccacagtgctgggattacaggcatgagccaccgcgcctggcctactactagtgagaggtgacagcgtgctggcagtcctcacagcccttgctcgctctcggcgcctcctctgcctgggctcccactttggcggcacttgaggagcccttcagcccaccgctgcactgtgggagcccctttctgggctggctaaggcgggagccggctccctcagcttgcagggaggtgtggaccgagaggagcgagcgggaacctgggctgcgcgcggcgcttgcgggctagctggagttccgggagggcgtgggcttggcgggccccgcactcggaacagccggccggccctgccggacccgggcaataagaggcttagcacccaggccagcggctgcggagggtgtactgggtcccccagcagtgccagcccaccggcgctgcgctcgatttctcaccgggccttagctgccttcccgcggagcagggctcgggacctgcagccctgccatgcctgagcctcccacctcctccatgggctcctgtgcggcccgagcctccccgatgagcgccgccccctactccacggcgcccagtcccatcgaccacccaagggctgaggagtgcgggcgcatggcgtgggactggcaggcagctccacctgcagccccggtgcgggatccactgggtaaagccacctgggctcctgagtctggtggggacgtggagaacctttatgtctagctcagggattgtaaatacaccaatcggcactctgtatctagctcaaggtgtgtaaacacaccaatcagcaccctgtgtctagctcagggtttgtgaacgcaccaatcgacactctgtatctagctactctggtggggccttggagaacctttgtgttgatactctgtatctaactaatctggtggggacgtggagaacctttgggtctagctcagggattgtaaacgcaccaatcggcgtcctgtcaaaacagaccactaggctctacccatcagcaggatgtgggtggggccagataagagaataaaagcaggctgcccgatccagcagtggcaacccgcttgggtccctttccacactgcggaagctttgttctttcactctgcaataaatcttgctgctactcactctttgggtccacactgcttttatgagctgtaacactcaccccgaaagtctgcagcttcactcctgaagccagcgagaccacaagcccaccaggaggaacgaacaactccagacaagccgccttaagagctgtaacagtcaccgcgaaggtctgcagcttcactcctgagccagagacatcacgaacccaccagaaggaagaaactccgaacatatctgaacatcagaaggaacaaactccagacgcaccaccttaagagctgtaacactcaccgcgagggtccgcggcttcattctttaagtcagtgagaccaagaacccaccaattacggacacgctaggttgctatctaaacaggtgcgaccagcttacctcccttctcctaaggtatgagaatccctgttttctgtactgtgtgtgttcaactttaaaactccccagagactgtattcgaggtttctgggacagtttctaaaggtgtttaaactgtaaaggatttctcctaacagaacctaccttcttgacagctctcaaaaatgtttttatttttgagactttttaaaagagctggccaggcacagtagcgcactgctgtaatcccagcactttgggaggccaaggtgggtggatcacctgaggtcaggggttcgagaccagcctggccaacatggtgaaatcccgtctctactaaaaatacaaaaattagctaggcatggtggcgcacgcctgtaatcccagctacgtgggaggctgaggcatgagcactgcttgaagccagaaggtggaggttgcagtgacccgacactagcaactgcactctagcttgggtaagacaagactatgtctcaaataaataaataaatattacaaataaataagacctctgcagtttattcctctgggaattaggtccagctccccatgtccattaaacctatgtgaacatgcgcaaccaggcctgaactacatttgtgtgttgatgtagagaaaaaggaggcagggctgcaacaaagtccacccagaggtctgcttcccccatcattcaccaagaaaccagctgccacaacagctctgagtgggagtttcttttcatgttgtttccaaaaataaaagccatagtcagcttgggaagaacttttcatcaagcagaacagagaaacagtagaaaagattcaaagagttggtgagattatccagtccaaccccatcgtttattacaggaggaaattgaaacccagagatgttgagtgactagttcaaggtcacacaaaagagtggaaaaaccagcagcagaacccacctcaaagccaggtgctctaacttccagctgagcatcttagtccattttgtgctgctataacacaagaccacagactgggtaacttataaagaacagtgacttcttacagttctagaggctgggaagtccaagatcaaagggctggcatctggctagggccttcttgctacatcatcctatagtggaaggcaaaagggccaaagattttgggggctaggggacaaactcatcctttataaagatgctcctctcatggtaacaaacccactccccaaatactggcattaacccattcatgaggccagaggcctcataacctgattacctcttaatggtcccacctcaatgctgttgcattggggattaagtttccaagacatgaactttggaaaatatattcaaaccacagcactgagtgctctttatgttacagcagggagtatctatgatctccactcacagtcctttaaggctaacttccttccaatctcagttgcttttaaaaatgacaggaaagtgaggcttcttgaaaatggatgtccgcataaaaatcatggtaacatatctatgagcctttgtgtgtgctgtccccactgccttggattcccttctctgcctaactgcttgaactcctcctcatccatcaaaacccaaagaattgctgccttctttgaaaatattccctgactctccagggcctctggttgttccctgctttatgttcttggccctgaccttgccccagcactcagaaccctttatggcaggattggttcttctccatgagagtgaaaactcttccaaggcagagatggaccaaattcatctttgcaacaccagcacacagcttaagctacaaaaggatggactttgaaccacaatctccacgcggaggggagtttatcattccaccccagctcccagctcacagtgtgagcccaagaagggtttgttgctgccaaaggaatctgaacagggaagttctgcaacaggaggggattctgatcctggagccacggagctttcaacagacacttcctggacgtgccaagcaggtcaggctgacaaacgagtgggcactaaaaggcacaagaagctctcacatgtgtacaggcctccaggactacaaagcacttgcaaaggtgacctcatctgagtaaactttgaaagtgctcttcagtgttgcttctgtgaggcctacttcactttttaccaagagaactgctcccaagtctggctgatcctgacctcaggactgtaagacatgaaggtggcacacagggaaggagtaagtcaagctaataaatacatgtctgaacatgcatttatattacaagacatacggggaaaaacaggagcaactctagccataaaataacccgtatatgacaagttaaattgagaaagaattacctactttcacgaagtgcgctgaggtttattgggctctgcgcttccttaagagtattagaaaagaacacacaaaatgctgaaatatgggatttcattatctcagtttactttaatttgcttgtttacacacacgatctgtgtgtacataacagtggcaagagccattctctaaatacaatctggtacccagactatgacagatgcacgtggaaaatgaggcgtcagtgaattaatctcaacatagaaaggcaaaataagcatggcagtattctatgatcacagatgcccccagagcctgggggtaaccgacacttttcaacataatacaggacaattttaacaaaagacccagactccaaatggcacccaaaatatattcgtttctctgccttctctagaggagtcagaaagttctaaaggcttactcaagaaaaaggaggcagggagactatggcctgctaagcacagatgctgagcactttacatgcaccatttctcttcatctccacctgacagacgatgaaaacgaggtttgccatgatcacacagctatcaggagtggtgccaagatatgaacccacatctcatgtttgcttgagcccaaatcctttcacttatgtcaggctgtttcacataggaatagaaagcatgctcccaaggaagaggcaagggggctaagcatggacaagtggcggaagcctcatcgatacagaaggctctgcaattgacactttccacatacagttaatttagtgctgagcccgcatcagacccacgtgggataaatatctggagatttaagtgtcacaaatgaacttctggggtcaccctgtgcctattcccttttggtgctgaacatgacactttggagagccttttttttttttgagacagagtctcactctgtcgctcaggctggagtgcagtggcgtgatcctagctcactgcaacctctgcctcctgggttcaagcgattctcctgccccagcctcccgagtagctgggattacaggcgtgtaccaccacacctggctaatttttgtatttttagtcgagacggggttttatcatgttggctaggctggcccaacctcaagtgatcctcccatctcagcctcccaaagtgctaggattacaggtgtgagccaccatgcctagcctaggagagctttcaatcccttcaacaagcccctgccatctactccatggccactcccaccactggtttatgggcataggcaacagagggtcacatcttaccaacgcctccaaagcaccatggtgccacctcccatatctcatcacctgtgtttctgctccttttgggtgcaacaaatcatgactcattgtgatggataaaattaacctccaacttgatgggatatgaaatatttaaaatatatccttatagtaaaagattttacaccgaagattcatcctcaaccacttaagcttcagtgaagccagtcaggtgtagtgcttctcagttaatgctactattggacttgattggagagaggggcatcaaggcggccttaagggtgattaccccaacagcaaggggctcagtttgaaaggcttaaggagacagtctgggagagaagaggggatatcttatcacagggcgtggaactgtgcctttgtggatggaggtgacaggatttctaacccttcccagcattgtcacagcaaaggccacagaatgacaaagctggaaactgaaaagtgctgcaaaggggagagaaaaaggaaactgatttcaagtccagctgaacaggcccaggtatggtttggtttagtttggttggtgatgcaagtaacaggagggagggaccacagccatgccacccttcaataagggtgattttgcaaacaggttggctttttgccatcagagggaggcattttacttcacttctgaattatcataatcttgtccaacaggtacagatgccctgggccacagcagagtgatcagtgcactcagcacatgaccctgaagcacactgttcagtctataccactgatatgtggtcagggacatttcggtgcaagaacgcattctgcaaaattaccttgattcaccttaaaattcaacaggctgttactaaaatgcctgctttctggtttgattatcttatttatttatagaaaccagggtctcactatgttgcccaggctggtctcaaactcctgggatccagtaatcctcccacctcagcctcccaaagtgccaggattataggtgtgagccactacacctggcccaggtttcattgctaacagagaaaacagccccatgaggtggaatttaagactgtaagaccagagtttggttcataacaagtacattagtgttctaaaccaaccaaccaatcaaccagccaaccaaccaaccaacaaaccctcaaaacaacctacatgtgccagagtgcagcactggccttgtgagttattttcaggagttttatcaacaaagaacaaatgtcacagttcttatcaaaaactgtaaaggattcgctcaaaatagaacagaaaaaaagtaatcttattgctccaaaaaaaccagcatatagtaatagaaaacatggacagaaaatgatcatagtccattacgtatgaatcatccaatacttggtcggagaggcactgcatctaaaagggcctgttttggtggctaatcgcaagtcagttgcaatatttaaacacttcatggatgaaacaaatattacaaccagagagtgtccttcaggcatcaggctgtttttataaagaaccctgcctgagccgggcgcggtggctcatgcctgtaatcccagcactttgggaggccgaggcaggtggatcacctgcggtcaggagtttgagaccagcctgaccaacatggagaaaccccatctctactaaaaatacaaaattagcctggtgtggtgacgcatgcctgtaatcccagctactcgggaggctgaggcaggagaatcgcttgaacctgggaggtggaggttgcggtgagccgagatcgggccattgcaccccagcctgggcaacaagagcaaaactccatctcaaaaaaaagaaaaaaaccctgcctgaaatagatgcctatgcaaaactgaccagtgggaaatactgttttgttttgttttttcttttttgaggtggagtctgctctgtcacccaggctggagtgcagtggtgcgatctcagctcactgcaacctccacctcctaggtccaagcaattctcctgcctcagcctcctgagtagctgggattacaggcatgtgccaccacacccagctaatttttgtatttttagaagagacgaggttcgccatgttggacaggctggtctcgaactcccaatctcaggtgatccgcctgcctcggcctcccaaagtgcagggattagaggtgtgaaccaccatgcctggctggaaaatactgttaagtaacagcagtaagagccgtgaaaatctaaagacaactggaaccagggagaaggcagcaaaggagtcccaaggctctggccactcctttagccacaccataaaggctttcctgattctgcccttttgctgagccttaggtccccactctagggacaaaaggagtgttccagataaaggtcaagtcttaccagggacaaaaagtgcctaactgggaatggtggtgcttgcaacactggtgatgtcgccaagaatagtctgaagactaaactcactccccagacttcagcaccacccaccaaaactgcctggtacactttccctctgaagtaggatcaataatttagccaaataactaagcaaaatatatatttgaaaaatagattagccattgtccttctgtcccccctctgttactcttttatttcttgtaactatcttgcttcaaattcaaactacagctctggggaggaagtcctggggaaaaggctttcggataccaaaacccgtatgtcccgtaccagctcagcaaaccaaacaaggtgccaaacaccttctgggacaagttgtggaaataaacagctgtgcacagaaacatcaacacccagatgaaagtcagaatgcccagggccacaaccagggtggtgatggcggtgtggaggcagtggcttcggtccgtcttcacctcatgcagcacagacatctcttctacaatcatgagggcgcagaaggtcagcaggaaggagtgacctgagatgtcaaagccatgccaaaagcccccttcctggtggcactgctgcttgctctggtgttcctttctgaccccctccagggctggggactggtagcagctgcccgtgtagtgttcgatgttggagaagatggaggtgcagatgtaccagatggccgtgcccacaagcagggtgctcagccgccgcaggaccaagccagccttgccggtcagatggtagttggtgagggcaatgaaaggcagaaggagacagaacgtccaggcccaggccactttgacaaaatacctgacagaggaggaaagtggaagtgaagagagggaacacggtggagaggacaccatgtcaggactcaggtctctacactgtcaggggagggaaaatgagaaaactgatcaaagctacagctcatagcaactatcatgttttaggtacttaccatatacttcacttactaagtactttatttatttatttatttatttatttttgagacagagtctcgctctgtcactcgggctggagtgcagtggcgcaatctcagctcactgcaacctccgcctcccgggttcaagcaatcctcctgcctcagcctcccaagtagctgggattacaggtgcgcatcaccccgcctggctaatttttgtatttttagtagagagggggttttaccatgttggccaggctggtctcgaactcctggcctcaaatgctccggccaccttggcctcccaaagtcctgggattacaggcatgagccactgtgcccagccctcccctcctcccctaccccacccctgtgtaagtactttaaatgtattaaccaggtaatccattaacaactctatgagttggccgggcgcggtggctcacgcctgtaatcccagcagtttgggaggccgaggtgggcagatcacgaggtcaggagatcgagaccatcctggctaacatggtgaaaccctgtctctaccaaaaatacaaaaaattagccaggcgtggtggcgggcgcctgtagtcccaactactcgggaggctgaggcaggagaatggcatgaacccgggaggcggagcttgcagtgagccgagattgtgccactgcactccagcctgggcgatagagcgagactccatctcaaaaacaaaacaaaacaaacgaaaaaaaacaactctatgagttaagtactgttaatatctgcctttaacagagaagaaaactgagacagagggaagtgccacaccaaaagtggaggccagaagcggaggagccaggattcaaatccaggatctgtcgtcttaagcactatgttatttacttaggaaaataatataaataaataataataactgagcatttaccaaatgccaggagctttcacacacattcactttcccatagagcactcacatttaccctgggaggaaggtgccattgttccattttatagacaagaaatctaaggctcagaaaagttcagtaccttgccagggtcacactcacacaaccagcatgaacagattaaaccacggtttggatagcccccagactcatgctgtttctcccataccatatgtggttttttattttttatttttatttttctgagacaggatctcactctgtcccccaggcttgcgtgcagtggcacaatcacacctcactgcagcctcaaactcctgggctcaagcaatcctcctgcctcagcctcacaaatagctgggattacaggtgtgtaccaatgtgcctggctaattttttttaattattatttttgtggagatggggccttgctatgttgcccccactggtcttgaactccaggcctcaagcaattatcctgcctcagcctcccaaagtgctgggattatagatatgagccatgcacctggcctggttctttcctaatggcagaaacagtcttacaacaatgagctttactttaagccaaagacacgggttcaactcttgactctgacttaacttattatacctcctacctctccagccctcagtttcttcagctattaaacagagctggggggaccaaatgatttttttttttttgagacagagttttcactcttattacccaggagtgcagtggcacgatctcggctcactgcaacctccgcctcccgggttcaagcaattctcctgcctcagcctccggagtagctgggattacaggcacctaccaccacactcggctaatttttgtatttttatttttatttatttatttattttgagacaaagtctcactctgccatccaggctggaatgcagtggcatgatctcagctcactgcaacctccgcctcccaggttcaagtgattctcttgcctcagcctcctcagtagttggaattacaggcacgcaccaccacgccaggctaatttttgtatttttagtagagatggggtttcaccacgttggccaggctggtcttgaactcctgacctcaagtgatccacctgccttggcctcccaaagtgcctggattacaggtgtgagccactgcgcccagcctggttctttcctaacggcagaaacagtcttgcaacaaggtcttactttaagccaaaagaccggggttcaaatcttcactcttacgggttcaaatcttcactcttacttaacttactatacctcctacctttccaggcctcagtttcttcagctatcaaacagagctgagaggaccaaatgatttttaaggtcccttctatatcccaggattcactagttccctctcattaatcagcacagaggcttggaacaaaactccaggatccatgactaccttcaaacaacaggggtgtgttgtcagccaggccacttggctcccagctcacctaggccagaggaagcagcagctgccttgtccgcctccccagcgttcacgaaaggtggctgacctaaacccaggacagagacttggggccactaccactctcatgatctattcttagcccagcctctcagggtgggtgaggaaggaaggtggaccaaggacagaaggacttttttctaggttccaatggattctcaggcaccacccccaggcctgtcactaaaatcttcactgggactgataaggaagatcttgccagagccaagacccgtcaggcatttgaggaagctgcctgtgaaaggaaccagggttttaagcagataaccaaagttgggctgactttcaggacacgccagagacacttattctggaaaacacttaggctcacatcaagggagcagttttatctttcagagtttccctttatgaccgcaacagagtttttgtgcaataaacttactaaccgggagttttgaaaaaagcaagtaagcaagcaaaggagtggatgggtggagttaaggagatgtctcaaagcgcccagctgggattgcttttctgggccactgccatgcattctgagtggctgagatgatccaaggagatccaggggaaagggcacagactagggggttccagccctctgtgagtatctcacaggcgggggctctgcctgtcacaggctggggcgaggctcttccacaggtcgtaaagggattctgtcacgcgctggagggatctgatctgacgcagggtggggtctgcgcggggtctgccacaggcaggcaggacagaggtgagatggcatctcccaaacagggcaggggtcagctcctaactccaaggggaggcgggggagtggtgacaggggctggttcatccccaccccattccacacccctacatatacagagacacacacgaccccgcttgtcaccacctgcccagtcaagctcatgctgcccaaagtgggtctgcaaacactaactgctagtgacaccagctaccccggggcctcccaggcgtgacacgcgtgcagatgctgctgtcacggctaggaggaggacctcccctccaatgactcgtccaccacggcagctagcaccggcttctctgggcgaggcgacagcgggccggctcgggcggggacagcggaggaccggggtgcactcacacgttgaggacgttgcgcttgttgctgaggtagctctcgggcaacggggacaactccttgaggagggagcccgccagcatggaggccaccagggcccagggcaggtagcgccgcacggccgcccgcaccagcgttccccgcaacaaccactcgcagcgctccagatgctccatgccggatctcgtcagccaccgtcctcctctccgtgccctctcggccaccgtatcgcccttcgcccggacctgcgcctccacctcccttcgagcgcatgcgcactgcccgcgagtcccacagcttgaggcgtgcttgggctccggagcccgcgcgctccccctcgtggccgctgctgcctctggcgcgtgacggtccccgaactcgctcgtctcctctgcgctctcctggccgcctcctctccccgagcctccgcgtcttgctctggtctgggaaaaagcgcttgtgaaagtatttgctggaggctggaagaggataaatgtagccctggagaattggagcagtagtcacagcatcatttgatctttcttggagcctcggagacacctctgccatctgagtcttagttttctcatctgtaaaatgcgagagacaagaggagatcaacctttcccaaaagctagtttatgagctcaggggttcattacgttggcacacgtagagggacatgagatgaagtttccttaggaataattattgtatttatttatttattagttagttgggggggggtccctctctgtcgcccaggctggagtgcaatggcaccgtcgcagctcaccgcaacctcaaatttctggtctcaagcaatactcccacctcagcctcccgagtagctgggaccacaggcgggcaccaccacacctggctaattttttttatttttatttctgtagagacagggttttgcttcgttgtcgaggctggtctcaaactcctgggctcaagcgatcctcctgcctcggcttcctaaaatgctgcaattacaagtgtgagccaccacgctctgcagttattaaattaattaattaatataattaatttatttagagacatagtctcgctctgttgcccaggctggaatgcagtggcgcgatctcagctcactgcaggcctctgcctcccaggttcaagcgattctcctgcctcagcctcccgagtagctgggattacaggcacgcaccaccacacccagctaatttttgtatttttagtagagatggggtttcaccatgtcggccaggctgaccaactcctgtcctcaagtgatctgacctctccaaatcttaacctcaagtgatctgccagccttcacctcccaaagtgctgagattacaggagtgagccatctcacctggtgcaattattacatttaaagtttaaatttctaaatttattttcacctgggcaacacagtgagactcagtatctataagaaataattttaaaaactagctgacttggtggctcaggcctgtggtcccagctactcaggaggctgaggtgggaggattgcttgagcccaggaatttgaggttgcagtgagctgtgatggtcccattgcactccagcctgggccacggagcgagaccgtcttaaaaagcacacaaagaaacacaaaacagctatctatgcctgttggatgaaaatgctggatgctgggggttaatggggagatcacatgaagttgttggagactcagttgctcagtttatcacaaaactaacccctcacccctggttagggctgggtgtctatttcagttcccaaccttggactcattcccttaccccaatgttagtttcctgtggcagctctaataaattactataaactcagtttatttttattcctttttttttctttagttttaaatagagatggggtctcactatgttgcccaggttgatctcgaacgcctgggctccagtgatcctcctgcctcggcctcccaaagtgctaggattacaggtgcgagccaccgtgcccaaccctaaacttgttttaaacaacagaagtttattccaaaagccacaaacccagccaatacacacatatatagtcatatcaagagatgggcattttaggccagacgtggtggctcacgcctgtaatcccagcactttgggaggccaagctattttgatcttggctcactgtaacctctgcctcccgggttcaaggtagtctcctgcctcaccctcccaagcagctgggactacaggcacatgccaccacacctggctaatttttttgtatttttagacagggtttcgccatgttgaccaggctggtctccaactcctagcctcaagtgatcttcctgcctctgcctctcaaagtgctgggattacaggcgtgagccaccacacccggcccaaagaaaaatttctatcgaaatattcatcatcactagctgcccaaaataattttgtgtctctataccaaggacagctaccacactgggaaatgttagcctgatttatgcctacaatggactaatgtttatagtctcatgcagagaatcaacaaattaatgaaaataataattccttaaaaccatcttaagatgaccttcatatctgtaaattgcatttatctgattagagttcttatatagcaagatgcttccaggccttcagaatgcttggtttaaaaaataaaatatagtgataattataccaatttggcatttcatgattgggaataaaaactacatagccagaaaggggttatttatgaaggcagcttgtaaatagtatctgataccatctctgtctccttgagtttgtcaggtgctcaattactgtggctttccttagcaaacagcataagaattaagagcagggatgctgggtttgagtgccggttctcctccttattagctgtgtggttcctccaaagaaaatccagatacgtcccccaacccaagaaggagggaaagactgctcggtgaatataaacactaaatatcaccccgagggactgtccaaagagtaccttctgaaaggttcaggatttgtatttttgagaaaggaaatgggtttgtttcctttgaaactgcagtttcattcctggagagttttctttccctccctcccttccttccttccttccattttctcttttctttttttctttttctttttttttttttttttgagacaggatcttgctctgcactcccaggctggagggcagtggtgcgatcatagctcactgtagccttgaactcctggcctcaagcaatcctcctgcctcagcatccaaagtgctgggattacaggcatgagccaccacgcttggccaccatggctggagatttttgaagactgggttaaactcaacctgaaaaaattgttgcaggtctctagagaagtttttgtatttaaaaaaaaattgaatcagtattgggaaatacatatttatgttgtgagtgaaatgatgtgctgtagtcaactcataccagcctgcaagagctgatgattaaattttcagaacttttgcggggtgattgtcaaacacagccatattaagaactgcattatagggcctgggcctgttggctcacccctgtaatcccagcactttgggaggccaagacaggtgaatcgcttaagcccaggagttccagaccagcctgggtaacatagggagatcccatctctacaaaaaatacgaaaattagccaaacatggtggtgtgtgcctgcagtcccagctactcaggaggctgaggtgggaggatggcttgagcccaggagactgaggctgcagtaagctgtgatcatgccactgctctccagcctgagtaacagagcaaaatcctctctcaaaaaaaaaaaaagttacatatataaaaaaacaaactgaaaatactcaaaactcattagttactaattattttactatgttttattattatctatgctcttggggtaacttacatctattgttcctgtatggtaagctcctgcacaactcttcccaaatctattcagtgatgtcacattgagagcttgaaatcagccacagggggagtatttacactatggaaattggcaggtgctacaaatcagggatttatttggtttgtctacattgagagtcaactccatttgtcaaaacatggttgaattgaaaccacaggttgcctatggttacaagaatccaacaaaaatcaataaaagcattctgtgagaatcaattagctatagttataacaaagagtatttatatatttcttttctttctttcttttttttttttttaagacaagttctcactctgttgcccaggctggagtgcagtggtgtgattatggctcactgcagccttaatctcctgggctcaagtgatcctcccacctcagcatcccgagtagctgggactacaggcggactaaatcagccatcacctctagctaatttttgtacattttttggtacagatgtggttttgccatgttgcccaggctggtctcaaactcctgggctcaagcaatctgcacatctcaacctcctaaagtgctgggattacaggtgtaagccaccaagcctggccatatattttattatttgtaaataatgtgctacacattaagaaacatttataataaacataggtaggtatatgcttatacatgtttccctagagagccaatagtaaacctttattttattttattttttatttttttgagacagagtcttgctttgtctcccaggctggagcgcagtggcacgatctcggctcaccgcaacctccacctcccaggttcaagcgattctcctgcctcagcctcctaagtagctgggattacagacatgcatcaccacacctggataatttttgtatttttagtacggatggggttttaccatgttggcaggtgtgagccaccacgcctggccttaatagttaaacttttttttttttttttttttttgagacagagtctgcctctgtcgcccaggctggagtacggtagcggcgatctcggctctctgcaagctccgcctcccgggttcacgccattctcctgcctcagcctctgagcagctgggactacaggcgcctgccaccactcccggctgattttttgtatttttagtagagacggggtttcaccgtgttagccaggatggtctcgatctcctgacctcgtgatctgcccgcctcagcctcccaaagtgctgggattataggcgtgagccaccgcgcccggccaatagttaaacttttatcaacaaatcactggttgtggcctagtacacacataaaaatttatatagtgtataagcaaatatatatgctaataggaatatagaaatagttttatgtctgggcgcggtggctcacgcctgtaatcccagcactttgagaggcagaggcgggcggatcacctgaggtcaggagtttgagaccagcctggccaacatggtaaaaccctgactctactaaaaatacaaaaatgagctgggtgtggtcgcacatgcctgtagtcccagctactcagcaggctgaggcaggagaatcacttgaacccgggaggtggaggttgcagtgagttgagactgcgccactgcactccagtctgggtgacagggtgagactctgtctcaaaaaaaaaagaaaagaaaaaaaagaaaaaggaaaaagaaaaaaagaaatagttttatgacaatttatggcagaattttcctctaccatgtgtgaagtactctgatgttttctactcagaaatttaattcaattttttaaaatgctggtcatgacccactgaaatgattttataacccactaaagggtaagaacctgtagtttggaaaacactgcattaagagagtttgaggcattagaaaacaatgctcctacacttcccaccagaggataatagaagaccacaagtttcagggttctgccctgcctgagacttcagtgggaccacctaattgttggttttcacctttcatttgtctattctacaaatacttattagaagtatatggtatctgcacaaataaatgaaaagatatccagtgttcatggactggaagaattaatattgttaaagtgcccatactgcccaaagcgagctatagattcaatgcaatccctaccaaaatgccaatgtcctttttcatagaaatagaaaaataccttcctaaaattcatatggaaccacaaaaaactcaaatagccaaggcaataatgagtaaaaaaacaaagctggagacatcttactacttgatttaaaactataccacaaaacaacagtaattaaaacagcatagtaatgtcataaaaatagacatagcaaccaatggaacagagtagagagcccagaaatgaacccatgcatatatggtcaattgacttttgacaaagatgccatggatacacaacaggaaaaggacagtctcttcaataaatgatgttggggaaaactggatatccatatgcagaagaatgaaactggatccttatctcacactatggacaaaaatcaactgaaaatggaatagagacttaatataatacaagaaattataaaactactagaagaaaacatatgggaaaagctacgcaacattggtttaggcaaagataatttgaccctgaaagtacaggcaagagaagcaaaaacagacaaaggggattacataaaaataaaaagcaggccaggagcggtggctcacacctgtaatcctagcactttgggaggccaacgcaggtggatcacctgaggtcaggagtttgagaccagccaggccaacatggtgaaaccccgtctctactaaaaatacaaaaattagctgggcatggtgacgggcacctgtaatcctggctactcaggaggccaaggcaggaatatcacttgaacctgggaggcagaggttgcaatgagccgagattgcgccactgcactccagcctgggtgacagagtgaaactctgtataaataaataaatagcttgtgcacaacaaaggaaataattaacagagtaaagagacaatgcacatattgggataaaacatttgcaaaccataagtcttataagggattaatgtccaaaatatagaaagaacttaaacaactctatagaaagaaaacaaataatcttattttaaaatgggcaaatggctgggtgtgggtagcttccacctgtagtctcagctacttggaaggctaaggtggggagatggcttgagccaaggagttcgaggctgtagtgagctatgatcactccactgcactccatcctgggcaacacagtgaaaccctgtctctaaaaaaataagaaaaaagaaaaggcaaaggatctgaatagctatttctcaaaacaagacaacatagaaatggccaacagatatatgaaaaaatgctcatcaacataactaatcattaggaaaatgcaaattaaaaccacaatgcaatatcaccttatacctgttagaatggcaattaggctattataaaaaagacaaaagataagtgttgatgaggatgtgaagaaaagacagcacttgtacactgttggtgggaatataaattagtaccagcattatgaaaaactgtatggaggttcctcaaaaactaaaaacaggattaccatatgatccagcaatcccactctgggtattcacccacaagagttgaaatcagtatgtcaaagagatgcctgcactcccaagtacattgtagcactgttcacaacagccaagttacagaatcagcctaagtgtccatcactgagtggatggatggataaagaaaatgtggtatatatacccactgaaatactattcagcctttaaaaaaggaaagaaattctgtcatctgtggcaatgcaggtggaattggagaacgttatacatatttaaataagctaggcacacaaagacaaataccttgtggacaaagacaatacttatatgtggaatctaaaacaatccaacacggccgggcatggtggctcacgcctgtaatcccaacactttgggaggccgaggcaggcggatcacccgaggtcaggcgttcaagaccagcctgaccaacatggtgaaaccctatctctactaaaaatacaaaaatcagcccggcgtggtggtaggcgcctgtaatcccagctactcaggaggctgaggcaggagaatcgcttgaacctgaactggggaggtggaggttgaagtgatccgagattgtgccactgcactccagcctgggcgacagagcgagactccacctccaaaaaaataaaaaataaaaaataaaacaataaaacaatcgaacacatagaagcaaagaacagaattacggttaccaaaggctagggggtgaagcgggaatgaggagatgatggtaaaagggtacaaagccttagatacacagaaggaataagttgattttttttgagggctattgcatggcatggtgaatatagtgcataatagtgtactgtacatttcaaaatcattaaaagtaaatttcaaatgttcttgctatgaaagatgataagtatttgagataatgaatatgtaaattagcttgatttaatgattccatactgtattcataaatcataacaccactttgtatcccataaatatatacaactataatttgtcaatttacaataaacttttttttttaaaaaaagaagtacatggtctctgacctcaaggaacttaaaatctagtgaaagtgataatcattaagttattcaatcaactaacatttattagctacttactctgcaccaagcattgggctagatgttgggacttctaatgtcttagataggtgagtttctttaataaccgcagatttttcaccctttaggaacatagtttcccaggtttgaggcagaatattcaacatgaggctggatcatcttgtcaaccaaaagcaaggaaatgttaaagcaaataaggagatcattaggctgaggttgtctctgtgcctagagctcttatgtaaacaaaccaaaactgggaggcatttcttgtaactgacataaaaccaaaataaaacaaaacagtctcagtcaatcacaaacagccaaccagctgattggttgtgtaactagggtcttcccatcacaccatacccaaataagacaaatgcctagttgtagccaattaggtgatttctgctttttttttgcttctgtggtcagcctgtaaaagcttgctgctcacacagctagtagagtgaagctctctgaacctcttccagttttgagtgctgcccatttcatgaagcattctttgctcaaagaaagcctgttaaatttattttgtctaaagtttttattttaacagttgccgtaagctctctaagactgctaaggtcaggagaacacaggaatcaatagaaaaccctcccacaggccaaagatgggcaacttgaacataaataataacggcaatgaatggaaacacacaaataggtttaaatccatgggttcacaatggtactttaaaaactaatgcccactttcagaggaaccaactcattattttgaaaactagtaaacaaaagtaaagaatcaagtaatttttttctgtctttcctatgtgaactgaaccactgagcagccaaacagtaggtgagcttctttttatagaaatatctcaataaatggctgggcatggtggctcacacctgtaatcccagcactttgggaggccgaggcgggtggatcacaaggtcaagagttcaagatcagcctggccgacatggtgaaacccctggccaacatggtgaaaccccatctctactaaggatacaaaaatcagccaagcctggtggcacgtgcctgtaattccagctacttgggaggctgaggcaggagaatcacttgaacctcggaggcagaggttgcagtgagccaagttagagccactgcactccagcctgggtgacagagcaagactctgtcgggaaaaaaaaaaaagaaaaaaaaaggaatatctcaataaatgaagaaggaatgatagaattagaatatcaccatatgtaacatgcaagtaaaaatttaagtttgcgatactgagtcacattcactaaagaagagtgagttgcagatactcataaacagaaaaatcttttttttgtttttgtggtttttttgtttgtttgttttgagacagggtcttgctctgtcacccaggctggagtgcagtggtgagatcttggcttactgaaacctccacctcctgggctcaaatgatcctcccaccaccatgtgtcaccatgcttggctaatttttaaagcttttttttttttttttttttttttttttgtagagacaaggtctcactatgctgtccaggctggtctggaactcctaggctcaagcaatcctcttgcccagcctcccaaaatattgggactacaggcacaagacactgcacctggctgagaaaaatttaataaaataaatatcagcagcactttaaatctctaaaaattcaccttataaattttaaattttaaaaatcaaataatcagaattttgacctttgctcagaattttatattttaggcttcttagagttggattttgcagaagcacatggcttcacgtttactgtggaaatgaactataaccaaaaatacatctgcctcaaaaaagcaacattttcttattgccaactgtaatttcaaactccatatatatgtcactgttttggcaagagtagtctctgagtctctcttaggcaaataaaactttttgagtttttaaaaaatcacttttacttgtctttttattttgatggcagtttgagtttttgaaaaacataaaatcactaaatttgtggaattgttacatgaaaatcatctgaggttatgattgtgctttggccaggttggacatttatatatatatataatattatgtattattaatatatgattatatattatatattaattagtatgtgtatatataaagattaaagtaaaaggaaatttaagtttaaaatgcttctcataaagaatttttctctttttttcccttaacccaaaggagtatatcataaagaatttttgggctgggtgtggtggctcacaccagtaaccccagtactttgggaggccaaagtgggaggattgcttgagcctgggaatttgagaccagcctgggcaacacagctagaccacatctcttaaaacaaacaaacaaaaaaaaattaggccaggttcagtagctcatacctgtaacaccaacactttgggaggccgaggcagcagatcacttggggtcaggagtttgagaccagcatggccaacatggtgaaaccccatctccactaaaaatacaaaaattagctgggcgtggtggggcacgcctataggcccagctactcggggggctgaggcacgagaatcccttgaacctgggaggcagaggttgcagtgagctgagatcgcaccactgtactccagcctgggcgacaaagcaagattttgcctcaaaaacaagacaacaacaacaaaaaaatttgtcaaagtggtgtcatatgcctagccatttgggaggctgaggccggaggatcacttgagcctgggcagttgaggctgcagtgagctgtgattgtgccactgaactcttgcgtggaagacaaagtgagaccctgtctcaaaaaaaaaaattgttctttataaccatattaagttaaaatgccagtgattcataaggggattaaattctgctggggtagaatactaaaaaatgagagtgtttatttccattttaaagtaaattggtggccaagcaaagtggctcacgcctgtaatcccagcactttgggaggctgaggtgggcagatcacttgaggtcaggagttcgagaccagcctggccaacacagtgaaacccgatctctactaaaaatacaaaaattagctgggcgtggtggcgtgtgcctgtagtcccagctacttggcaggctgaggcacgagaatcacttgaacctgggaggcagagtttgcagtgagctgagattgcaccactgcactccaggctgggtgacagaccgagactcttgtctcaagaataaaaaatcaagtaagttggttacagggagctatgatttcaccactgcactcctgcctgggcaacggggcaagaccctgtctctaaaatacataaataaacacataaataaataggcttgtgtcacttggttaaatggcaaaatgtaggaggtctttatgggttaggagtatccatcaaagattccatttaaaatatactttataatttacttatttgtgtgtttattttctgtctcccctggaatgtcagctccagagggtaggtaactttatctgtcttgctcattcatgcatcccaagtgtctagaactgtgttctagaagtttgtggttgaataaattaaacaatcattattaacacagtgatctaaaggaaatcattttttcttttttgagatggagtcttgctctgttgcccaggctggagtgcagtggctcaatttcggctcactgcaagctctgcctcccgggttcactccattctcctgcctcagcctcccaagtagctgggactacaggcatctgccaccacacctggctaattttttgtatttttagtagagatggagtttcactgtgttagccaggatggtctcgatctcctgacctcgtgatccacccacctcagcctcccaaagtgctgggattacaggcgtgagctaccgcgcccggccaggaaatcatttttaaatttaaattgcttctttacaactagaagagaaacaatggaaaataataaaaaattatgaaattattattttgagccaggtgtggtggctcacgcctgtaatcccagcactttgggaggctgaggcgggtggatcacgaggtcaggagatcgagaccatcctggctaacacagtgaaactccatctctactaaaaatacaaaaaattagccaggtgtggtggtgggtgcctgtagtcccagctactcgggaggctgaggcaggagaatggcgtgaacccgggaggcggagcttgcagtgatccgagatcgtgccactgcactccagcctgggcaacagagcgagactccgtctcaaaaaaaaaaaaaaaagatattattttggagtgatgcaaagaaaaaaaaaagaaattatcattgttttaatcttaaggagttcccaagattatacatctgtgtgaaagggattttctgctctatcaagtctgaaagatgctgtgataaaatgacaatggtttaagtagagggtgcttggggtcagggaagagttcttggaagggatgatttctgtctaagtcgagatctgaaggattggccagaggaacagtgggaagcagtcattccaggaaaagcaaccagcaggtgcccttgtgttggctgatgtgcatgaaataattcactctgggttgggagtcaggggcagcagcccagtaattctcccagtgggaggccctctttgtccacagctactggccagtgaacaggaggattcatctccagcaccagctccttccttctgagttctcctctgcaatgcctcccccattactaacctctagccacctctccttctgccaggaagggacgactagccactccctggggtgaggcagctgagcacagctggtgtctgccagaggccaggctgcctgactgcccaactgggaagggcttgtctccactgactgttccctgaaacacacacaagcccaggctacccatcacctgggcccatctggggcacagggtcagcagggctggcggctttactcagttgcaggctgagtggcagggggggttcctgggaccctacacatccctggcagtcttgaagaccctccagcttcctcctctggtcactgtctcctgcagactccagtacctcctatcttagacaggtcatggccagggaggagagggaagcttttgttacctgaaagaccaatggtaggtcaggcaaggtggcttatgcttataacccagcactttgggaggctgaggtgggaggatcacttgagcccaggagttccagaccagcctgggcaacagagagaccctatctctacaaaaaaaattttttttaattagctgggctcagccgggtgcagtggctcaagcctgtaatcccaacattttgggaggctgagcagatggatgtcttgaagtcaggagtttgagaccagcctggccaacttggaaaaacccagtctctactaaaaatacaaaaattagccaggtgtggtggtgtgcgcctgtaatcccagctactcgggaggctgaggcacgagaattgattgaacctcagaggcagaagttgcagtgagccaagatcatgccactgcactccagcctggacaacagagtaagactctgtctcaaaaataaaataaaataaaaaacaagctgggcatggtgatgcactcctgtaatcccagctacttgggaggttgaggcaggaggatctcttgagccccagagcttgaggctgcagtgagctgttatcacgccactgcactctaccctgggcaacagagtgaggtggctcaggcctgtaatccagcactttgggaggccgagacgggcggattgcttgagtccagacgttcgagaccagcctgggcaacatacaaaacctcgtctctaccaaaaaatacaaaaattagccaggcatggtggcatgcacttgtagtcccagctactcaggagacaggtgggaggatggcttgaggccaggggttccaggctgcagtgagccgtgatggcaccactgcactcctgcctgggtaacagaataagactctgtctcaaaaataaatacatttttggctgggcacagtggttcacgcctataatcccagcactttgggaagccaaggcgggtgaatcactggaggccaggagtttgagaccagcctggccaacatggtgaaacctcgtctctactaaaaatacaaaaattagccgggcgtggtggcagctgcctgtaatcccagctacttgggaggctaaggcaggagaatcacttgaacctggggcagcagaggctgaagtcagtggagattgcacctctgcaatccagcctgtgcaacagagcaagactctgtctcaaaaaaaacaacaaataaaataaaattacaaaaaataaataaataaatttttaaaataaaataaaataggctgggcatggtggctcacacctgtaatcccaacactttcagaggctgaggcaggatgacttgagctcaggagttcagaccagcctcggcaacatagtgagacccttgtctcaacaaaaagtaaatttttaaaaattagcccgaagtggtggtgtggctgtagtcccagatattgaggaggctgaggcagaaggatcgcaggagttccaggccgcagtgagcaggcctgtgccactgcgctccagcctgggtgacaaggtgagagagaccctgacacaaaacaaaacaaataaaataagataaaataaaataaaaaagatatcttcagctgctcctagtagcttgagagataggtcacgcagtgtcaccatccccatttaacagatgggaaggctggctcagttttgaggccacagaagagcaaggaggccctaagggtctcacaagtcccttcccgcccttaccctgttgaattcttagggtctggcgccaggacacggccgcggggccctaactcccggcccgctcaggaatgtggggcgcccgcgggccggtggcaaggcgcgggggcgcgggggcgggatggggggaggggcgctgacgccgagccttttccgctccagctgcgcgggccggcgacacagcaaattccgagggcacacctggctgtgcagctgtcccgggacgaggatttcccagtcctccggtcgccagccccccggggcacggccttgaccccgggactgcggggccccgcgcggcacaggagctgggggcgccccctggggttaagcgcgctaggccagccctcgccctccccgctgccaaccccaaccccctggcaccgggtgtggaggcagctctgcctctgaaggtggtcccggtccgcgtggccttgccagctccaccttccaggaacctcctccccaccttttcaaagggcgctagtcctttccagcacccaggagggtgagggactccctaactcagcccttgataaccccttacttaatgggagggcaaggatgaggaggggcagctcaggggccctctttggttctgcgttctaggggtccatgggaaatcagtcctaggaagatggactgggatgaggggcccccccttccctgaagggctaggctctccctacctccttcccacccccatcccccaagccccttagggctccaggacccagcacagggcaaggcctccagccctgcaaaaactggcctctgtttacctctgagcccatctctccatccacctcttacactcttgaccctctaggtcctccctaacctgaccttcttcagttcttttttgttgttcttttttgttttaggggcttttttgtttgtttttgttttcgttttgagacaggatcttgccccattgcccaggctggagtgcagtggggtgatctcagctcactgcagcctctgcctcccaggttcaagccgtactcgtgcctcagactcctgagtagctgggaatcacaggtgcgcaccaccactcctggctaatttttttgtatttttagtagagacagggtttccctatgttggccaggctggtcttcaactcctgagctcaggcaatccgcacaccttggcttcccaaagtgctgacagtctttagttcttttttttttttggacacagagtctcactctatcacccaggctggaatgcagtggtgccatctcggctcactgcagcctccgcctcctggattcaagcgattctcctgcctcagcctcccaggtagctgggattacaggtgcaggcaccaccatgcctggctaatttttgtattttctgtagagatggggtttcaccatgttgcccaggctggctggttgccaggtgatccacctgcctcggcctcttaaagtgctgggattacaggcgtgagccaccacaccgggcccttcttcagtttttaaaatgaatctgattccctctagcctcagagggtggacccagtggttccctctccttgctctgccatcttcccccctcctccacattccagcttccggttttcttcatctgacctccacttatttttctgttttctgcttagtcgtcacctgttactaacattgtcatgaacgaagtgttttgaaaatccttgaaccgtagttcttctacaggaaggttagaatcagccctccagcttcctctagaaaccttgttggaattttgattgggattgtatcgaatcatagattaatctggagtaaactgacaacacataggtttaccaaaatgatgacatgagtcagtgacgatacaaattagacataactccttccttcgaagagcttatttatactcttcctattttgttttactttattttattttgtaagagaagatcttattgggtccattttacagatgaagaaactgaggctcgtgagttgatatgactggctctggtcctatggtaaggaaaaggtggggccaagatcccacctatgtctgtttggctcaagaatctgcctattcagtcgattcagtccatgggtttggtttgtgtgtgtgtctgtgtgtttgcaggtagggtatgtttccatgtacccagagtggaaaagcatctctatttaaagatagatggggttgaggtggagtgtaggcgtgtctgctttattggaaggtagcttctatttgcgttggtgtcaaggtcattagcaatgtgtgtagtgttggggggctagtggttatattggggagggtatttatgtgtattgggtaggaagtatgtgttggggggacaagaacaggatatttctgttggtgtgtgtgttttttcttctatataattttacttttatacctgttgaaagtgctcttttaaattgaacaaacggctaggagcagtggctcatgcttgtaatcccagcactttgggaagccaaagcaggaggattgcttgagcctaggagttagataccagcctgggcaacatggcaaaatcccgtctcttaaaaacaaaacaaaaaaaaaaacagatataaaacatgtaaaacacccctgtaggaactccctcatgcctcctctgagccagtaacccccaactcctcgcaaaagcagccactgttctgacttccattaccctaagttaggtttgcctgttcttgagtatcttgtcaatggaatcacacagcatttctctttggcgaggttaatagctgatattgaactaagtttgctctgtgtgctaaaaactttccatatctcactgaatttctcctaatagccgaatcagctagcacctgtttatttatttatttatttattagagacaggcctctgtcacccaggctggagtgcagtggcatgatcacagctcactgtaccctcaacctcctgggctcaagcaatcctccctcttcagcctcctgagtagctagaactatgggcacataccacgaggcctgactaatttttgtacttttttttttttttaagatagagtctcacagtgttgcccaggctgctctcaatctcttaggctcaagtgatcctcccgcctcggcctcccaaagtgctgggattataggtgtaaaccaccatgcctggccagcacctattaattgttcccattttacagatgagcaaatgctcagagaaggcccacgacttgttccaggtcactcaagagttatcagaatccacagctctggtccatgcttattagacggtcctgcctcccttggggtgatctgcagaagaggggcactgctctctgagtgcagagagcagaagacagagcctggagctcagagatgcttctgtgtgtgatttattccccaagtcggtttctcagaatctgttgtgaggcctctccaaccccgccttgctgggtcagggactcagcagcccaaccactgctatgctgtggagactcatcaagctatgggggtcgagtcccagctccgggatttatttgttgtataactttgggcaagttgcctctgtctttgaacctccgtgtcctcaactgttaaaaggaggttaaatttctcctgcttggttaaggggtaacagatggaaggtgtcactgtataaattgctactgttgctattttctttaaaaaaataaaaaactttttatttttaattaaaacacaaatattgaaagtcacataaaacaaacaaggaacctactaggttattatgaggtaaacagcttgtaaccacaggccagatcaagaaatagaagccctgccgggcgcagtggctcacgcctgtaatcccagcactttgggaggataggtgctgggatgggtgccgaggcgggtggatcacaggagctcaggagtttgagaccagcctggccgacatggtgaaaccctgtctctactaaaaatacaaaaaattagctgagcatggtggcgggcacctgtaaccccagctactcaggaggctgaggcagaagaatcgcttgaacctgggaagaggaggttgcagtgagccgagatagtgtcattgcactccagcctgggcagaaagagcaaaactccatctcaaaaaattatatatatatatatatatattttttttttttctccttaaatgccccaccccagcctgcctttatagtatttctttgtttctttacagttttacacccaaatgtatagcctttaagtctatagtaatttgcctcccatcccctttgtttccttacagtttgtcttttgaagaacctggggcattgaattttaagagtttccgcagggctgggcatgttggctcatgcctgtaatcccagcactttgggagcccgaggcagatggatcacctgaggtcaggagttcaagaccaagctgaccaacatggagaaaccctgtctctactaaaaatacaaaaaattacccgggtgtggggcgcatgcctgtaatctcagctgctcgggaggctgaggcaggagaattgcttgaacccgtgaggcggaggttgtggtgagccgagatcgcaccattgcactccagcctgggcaacaaaagcaaaactctgtctcaaaaaaaaaaaaaaaaagagtttcctcagagcctggatcctcgctgctcttttccactcacacacccttctctccggcttcctccctcctcctgcttggatttggagtaacatagatctgggttgcagtcctgagtctacctgttcctgtgtgactttggacaaatcacttaacctctctgaacctctttcctcaactgacaaatgggtacatgacctagatcatctctaagggccttcctgctttctcagtctcctctctcaagcaccaggctcttgccccacagtctcttctcaaaaacaacttttttctttgtttgttttgagacagagtcttgctctgttacccaggctgttgtgcagtggcacaatctcggctcattgcaatctccgcctcctgggttcaagcaattctcgtgcctcagcctcccgagtagctgggactacagacgtcgccaccatgcccagctaatttcttgtattttttggtagagatggggtttcgccatgttgatcaggctggtcttgaactcctggcctcaagtgatccacctgcctcagcctcccaaaatgcttggattacaggcgtgagctaccgcacccagccaaaaacaacttgactgggtgaaaagaacactgggtaagagtcagagagacctggccttggaatctagtttccactggaactagctgtgtgaacttgagcaagttacttaacctctctgagtttccacttccttgtctatagaatggggatcctgaaacccaacccgtgaaactggaatgaggcttacctgaagtcatgtccctaagacatttagtgtctggcatctggtatgtgctacagaaatgttgactgttattgttattagctattattattcattatttattgactgtttgctctgtgccaggcattgtgtcaagtgtcttaagatgtactaactcatttaatcctcacagccatgctatgagatagctgcatcttatagatgaggaaactgaggcacagaagggttaagtaaattgctgatggtcacacagctaaaaagccatggaattgatccatgaacccaggctatctggatgcagagcctgctctatcacccaccaagctgcactgtctcaaatactactactttctggaagaatgttctctttgcttgtccaagcccagagagaattccagtaggggtgaggatggagcagtagctgaattcagttggtcaaatccaagggtgagaaagacgttcttaccctaacgcgagataaatgtccagggcattaacttgagctggcccaagtgcagtggcctacacaggtaatcccagaacttcgggaggccaaggtaagaggattgcttgagcttaggagttccagaccagcctagtcaacatagtgagaccttgtctccactaaacattttaaaaatcagccgcatggtagcacgtgcctatagtcccagctgcttggggaagctgaggcgacaggatcatttgaacctgggagatcgaggctgcactcagtcataatcgtgccactgcaccccagcctggccaacagagcaagaccctgtctcaaaactaaaataaaaatacaaataggccaggcgcagtggctcacacctgtaattccaacactttgggagggagtttgagaccagcctggccaacatggtgaaaccccatctctactaaaaatacaaaaattagccaggccacggttgtgggtgcctgtaatcccagctacttgggagctgaggaaggagaattgcttgaacctgggaggcagaagtttcagtgagatgagattgtgccacggcactccagcctaggcaacaagagtgaaactctatctcaaaataaaataaaataaaaataaataaataaaaataatttgggtcacccctgattatttcctgaccccacccctaatattttacccattgaaaacctgccaaaatgcaactgggaccagctttcttcaatgggggcagcagagagggtctgactgggatgtggctgtgtgtttgctacgagagtgaatttctgtgtttctgtggatgcatgagtgtgtggagtaggcgatggtggtcttgtctgtgtggctggactgtggggtcttcctcgttgtctgtctctcaacactgtggagaggcagtatgggggtgcctgtcccacctctcccacccacaggatgtgtgacccggggcaaatgactcacctctttgtgccttagtttcttcatgtatataaaaatgtggatgatgataataatagggttattctgaagattaaatgagattgcccatgtaatgtgcttaaaacagtgctggccacttatgagaaagtagctaataccatcagcttatatgtagtagacatgcttaagtgtgtaacctgtgggtttctgtatatttatacaggacacctgtggtgtacaatggagaggatatgagggcctggcggggacgagctctctgtgatttgtgggaggggatgtgcttatatgagtgtgtgcacaaacgtgtgtgtgtgtgtgcacatacatgtgttgtgtgtacagcagatgcctgcgccttctgcacatgtgcaaggacgttcactgccaggacccaggttaccacacaaacagtctccatccctaggacaagtcactgaggctcacgtgtgcctcggttccttcatctatacaatgggtggagtcactaccccaaagggagctgtgaggcccaagtgaattgaggatgtgaagttctgagccagtgcaaagtgccagttacataggagtggcttgtgctatgcgttctgagagagccgggcttacttgttgacactcctgggttcctaagtgccatggctgtttgtgtctgccttccctgggctgcagaatttgccctggtgtatcgaagatcccacctgttgttgtccgaagagccagaattgggaacctatcaaagagaaactgggaacagccttcttcagtgggggcagcaatttcagttcagtttcttcagtggggcatccaaggcccaaagaaggataagaacttgccttaagacacccagcacactggaggcagagacggggctagatcgaacgagtctctcttgtccttctggcatagtgggagagcccccataggggtcaggggtcgcagccctcacccctcactgctctgccctccccaccttccccagcatccagcaggaaggtcactgctccagcaggaaggtgtgtgctttggcagccgcactgtctgggctgcctgtggtgggaattccacatgtctggagaggacccgtctggagtagcccagtcccagcccccagccctgcttcgccagctggcccagggtttggcctgctgccccgagactaggttcagcctgggaatcctcagagcttgctagaagagtagtctgaggattgcaaattcttcacctgtgttttttatataacacctttctgttgtaagtctatccccttctattacaaaagtaatgcattttatttttggggaatacaagtaatgaaagaggagaaaattgaactctttcttaacctaggacttcagcaactcagagactgagactttaaacacacacacacacacacacacacacgcacacacgtccattatctacatactcatacattcacctggggacacatttgactcaagaacactcaaacacacacacatgtaagtatacttgcacacacatacacaagtgcatacatactctcacaagtacacacgtacacacaaacacattcacacacacattcctagagtgcacacagtgtgccagccactgtactaaggctccacaaatgttcactcatttcatcttcgcagtaatgctacaaggtaggcaccgctatttctcccattttacagatgaggcacacaatggttgagtaacgtgcccaacacctagttagtgagggggtgggataagggaaatttgaacccagatttgtgggcttaattcatttgctaatgaataggctgtgtttgagtggcatcataacgaacatcaccctaggcttttttccttatgcatctatatttggtttggttagaaaatggcatctttggctgatacaaaaaaattagccaagtatggtggtgcgtgcccgtggccccagctattcaggaggctgagatgggaggatcacctgagcctgggaggtggaggttgcagtgagccgagattgtgccactgcactccagcctggacgacagagcgagactctgtctcaaaagaaaaaaaaagaaagacagcctgtccaatatggtgaaaccccatccctactaaaaaatacaaaaattagccaggtgtggtggtgtgcacctgtagccccagctacttaggaggctgaggcaggagaatcgaggttgcagtgagccgagattgcgccactgcactccagcctgggcgacaaagtgagacaaaaaacagaaagaaaaaaaaaaggaaaggaaaaggaaaaggcatccttttagatactaaccaggcctggggtcagatctggacttaaatcctggcgtgattgcagactggctggcttgactttgggcttgttctttctcctctctggggctcagtttcctcatctatgaaatggggagctatagtacctgcttctgaaggttggctgggcttttgtgtaaagcactcagccctgggcctggcacatagcaggggctcactagatgggccatattaactgtctgctccaaggctggagggtgttatagggaaaacagtcagaaaatactctccagatgcaaggtggccttaatatgtcaggatgtggaaggcagagagaagcctcggggtctgggatctcccataggggatgagtattttttcctggaatccctgccctgttgccacatcactaccctgaccatttgcccagcccagccctacatgcttcaggtgaaagcagagagagaggggcgggagagaaaagcccatcaagcagcaggcggagcctccctgcaggagtctggcctggctggaaggggagggggctgtggggccagggacgtcagatgccaacagcaccaggggaccgttaaagttgctgcgccgccaggtgggccagggtgtctgcagaggtccccggcctcctgggctgccgcctgccaccgcttgggctgcccgtcctgggtacgcaccgttggagcctcctgcctggtctctcgtgcttctctgtctcttctctaagtcgatttttcgctctttcttctgtttgtgcccctctctctgtctatttctgtcctcccccagccacattgttgcctctctctcattctctcttatctctttacctttctatttctcattcttttttctctgtaactctttttttctgtcccctttttggtctctcttttttctctgcctctttcattctctgccattgggttttctctgtgtctcattctcaattcctaaattgcagcaaagcagggacaaaaggaccttgcaatatgacttggggtaaggtgggccctgccctccgagggcattgactgagcccgctccagcaggattggtgaagaggatgtctagactggagagggctgctgtctgtctcctgggctggagggacagagcactggctttgaagtggtggcaccatctcaccccagggccatgtctggattagccactgtctgggcatttcttccccttgcccaacccactcagtcccctggggtggaaaggaaggggtgctgggcatctggaccagagctgcatctggaggtctttgccaagttcccaggaggcagcatcctctgggtcggcactgttggagaacgctcagggtctggtgctctcgtgcctgccccttccaggcagccggctctgattgcacaaggcagacctgtgactcctccatccagctatgcccctgctgcccagcaccgtgggcctggcaggcctgctcttctgggctggccaggcagtgaacgccttgataatgcctaatgctaccccagccccggcccagcccgagagcacggctatgcggctcctgagtggcctggaggtgcccaggtaccgccggaagcgccacatctctgtgagagacatgaatgccttactggattatcacaaccacatccgggccagtgtgtacccacctgccgccaacatggaatacatggtgagtccccgtacctgccccccaccccccgcagtgtcccttccggcaaacgcagccggactcatcttggcctagaatgactggctttgaagagctggaccacttgcctgcctggccccactagccagtatctgggtgtcgacctgtggaaagggcaggagttaatctgcccattttacagatgaggaaaccaagaaggttgcacagctgttccagtgagtcaggcatgtgactactatgtaaggagcaccactgtgcgccaggcactgcacgtgagtatcatctccattttccagaggaagaaactgagactcagagaattaatttgcccagccaggatttcaatccaggtctgcctgctgccacctggcaccatcacaactgtaaccatcacaatcccctacccaagaattttggctccccacactggggacctgcatggggtgcgtggctggtgctttctatgctattgtctctttaccctaaggtcttgactgacacacccacagcatcctccacaagcccctggaggcaggcttggagcagtggggacaggtactggggaatctcaggctgaggaaaaccaacagctgaccagcagaggaagctgggatgtctcccctcaaagaggcagggctggtggctctcactccagcccccaagaagtcaaaggagggcaccaaccttttgcttacagctcctcccccagggccactgtccaaaaccagcctagagggatgggtttccagcccacccagagatgtctttagggaaagagtttgccagtctgccccctgaaagaccaacacatgccactcgatagcctgaaaacttaactttttcatcgtatccattgacttatacttggagtacacttgcagccaggcaccgtgctaagccttgtggatactgctggtaacagaatagacaaggccccttccttcacgaaggtgacattttagtgggaataagagaaaacaagcatgaacaacaagatattaatgtacataagataacgtgaggaggcaatacagtgttgggaggggcgggaataagagccgggatggcaggcagctagagtgcaggggagtcattgacttgttcattcattcgttagcacctagaatgccctccatttttcaaacaaatggcacatttattgagcacccgttgtgcgtgtgtggcacctgccccaacaggtgtttaatgattgcaggcggcatggagcagagagggttcaatatctcaccagggactccagggagggcctgaacatgtaggtttgatgtttagcctgctccttccctcactttacccctttgtagcatgagggaagcactcctctgctctccctaaaagactgagccagagagccgggcgcagtggctcacgccagtaatcccagcactttgggaggccgaggtgggtgaatcacctgaggtcaggagttccagaccagcctggccaacatggtgaaacccagtctgtactaaaaatacaaaaattagctgggtgtggtgatgagcgcctgtaatcccaagctacttgagaggtggaggcaggagaatcgcttgaacctgggaggccgaggttgcagtgagccgagatccagccagcctggatgacaagagtgaaactctatctaaaaaaaaaaaaaaaaaaaaaatattgggccagacaaccctggtagatacctggacccctctttggatgccccatttctccctccctagctgacttctactcacagaacaggctgtccaactcgacagcctttgccctagcagcccttctctcactgccgcaagaaagtttggctcccatttctcactctcacaccgaccaggactgtaataatcaatgacttgttgaaggccttgttgccttgctaccctgagtcctcagtgcctagagatgttgtttgatatttgatgaatgaacaaatcctatttcagagaatcccaggaagtcagagatggaagggaactagtattttaatgacatattttctggttataaaacttggagaattcatacattggaaaattacaaaactgttaaggaggatgaggagggcattcaccatgtagtgatggggaataatcactaagacaaaagagcaaggtgcagaatagaatatgctgccatttgcctatatatatgtgtgtgtgtgtgtgtgtgtgtgtgtctgtgtgtgtgtgtatatatagagagctgcttgtacaggtatagaatatatacctgtatacagaggacacaagaagcagtggtgactgcctcttgggacggtgtgcagggtggtggggttgggggagaagtataggagagagatgagactttctactgttcctccttggttatctatttttgttgttgttgacacggaatctccctctgttgcccaagctggagtgcagtggcacgatctcggctcactacaacctctgcctcctgagttcaagcaattctcgtgcctcagcctcccaagtagctgggaccacaggtacacaccaccatgcctgactaatttttgtattatcattattatttttgaagacagagtttcactgttgttgcccaggatggagtacaatgatatggactcagctcactgcaacctcggtctcccaggttcaagcgattctcctgcctcagcctcccgaatagctgggattataggtgcccgccaccacacccggctaatttttatatttttagtagagacagggtttcaccatgttggccaggttagtctcgacctcctgacctcaggtgatccgcccacctcggcctcccaaagtgctgggattacagatgtgagccaccatgcctggcctaatttttgtatttttagtagagagggggtttctccatgttggccaggatggtctcgaactcctgacctcaagtgatctgcctgcctcagcctcccaaaagtgctgagattacaggcgtgaaccactgtgcccaagcggatatcttacatattaaaattatgcatattttcacgatttaaaaaagcttttgacttaaccattttcaatgttaaaataaacacatttagaaaatactacaaggccgggtgcgatccacctgcttcagcctcccgaagtgccctgtaatcccagcactttgggatgctgaggcaggtgaattgtttgaggccaggagttggagactagcctgggcaacatggcaaaaccctgtctctacaaaaattagccaggtgtggtggcatgcgcctgcagtcccagctactcaggaggctgaggtgggaggatcgcctctcacctcaccacctcccactgtaccaggaggcagaggttgcagtgagctgcgatcgcaccactgcactccagcttgggtgacagagtgagatcctgtctcaaaaaagaaaagaaaagaaaaaaagaaagaaagaaaaagaaaatactataagtacaatttaagaattagttattttctcatccttctgggttcagtcacttctagggactgctgagaactcctgtacgaacaccctgggacctgctcagagcagagcccaagctcagagtcaagagatctgggtgtggaccccagctctggtatggactcatggttgcccttcaagtcatcagcgagctgagcctcagtcttctactttgtcacgtgggtttgttgcagggttccagggagatggggtagaaacggcaccaggtaaatgtgcatctctggacacagttgtgacgatggtggcaattcccctggggaatttcattgcctttctttccccaggtctgggacaagcggctggccagggctgccgaagcctgggccacccagtgcatctgggcacatgggccttcacagctgatgagatacgtgggccagaacctctccatccattctggccagtgagtgaccctctgcccttccttcactcagtcattcaacaaatactcattgaacacttactctgtaccaggtgctgcacttgacactgggatacagtggcgagcaaggcagacaagctctccacctgcagggagcctgcattctagttagaaggggcaggcaaaaccctaacaaagttgtgtatacattgaattgaggcaagtcttgtttggtttgagaacaaacaagtgcacagattgtggtggaaagtgaggagggattggaagactaagaaaataggataagggggccgggcacggtggcttacacctgtaatcccagcactttgggaggctgaggtgggcagatcacttcaggtcagtagttcaagaccagtctggacagcatggtgaaaccccgtctctaccaaaaatacaaaaattagcccagtgtggtggcgcatgcctgtaatcccaagtactcgggaggctgaggcaggagaatcacttgaacctgggaggtggaggttgtggtgagctgaggttgcgccactgcactctagcctgagtgacagagtgagactgtgtctcaaaaataataatgtcaataaaataaaataaagataaggggataaaataaaataaagataagtctgagaatggcaaacccacccttctggcctgaccttctcaccgccattctgactgtcaagtcagattccggggaccttctgatctgggtagccttgggaagttatttccactttctaaaccttggtgtccctgtttgtaaaacaaagttgttagcctagctcagttctttccagacttgtggatttcacaggcctataaaattgcaaaaagaaatctgtgagactgccacacaattgtcagatttttattttgccaaataaggatgtcagaaaaacaactaccttcccatcctcgccattctgccatcaccccggggagagtgggaaagaattaaggccagtcccttcaagtgagctcagtggaaattcagggccctgtctgtgttttttcatgtccttcactggtcacaaccagcaccagcctctgagagccgtgaatggtcactcagagccctacagagcagacatcgggtgattcagtcctgcctccatttcactttccctctcccccgctgctgaactcttcctgccagactccacccctacccatggccaccatttgagaggctcacagagagaaagaaagcagtgttagacacgaagctgtgctgtcgtaaattatgaatgtgcattcttccagattttctccctctttagtcatttatgtatatttttatatatttgtgcccctgtcaaatatgtgtaatagaaaaagccctcagaggccgggtgcggtggctcatgcttgtaatcccagcactttgggaggcagaagcgagcggatcacctaaggtcaggagttcgagaccagcctggccaacatagtgaaacctcatctgtactaaaaatacaaaaattagccaggcgtatgcaggtgcatacctgcagtcccagctacttgggaggctgaggcacaagaattgcttgaacccagaaggcagaagctgtagtgagctgagatcacactgctgcactccagcctgggcaacagagcgagactccatctcaaaaaaaagaaaaagccctcaggtcctcccagatggcttttcagactacagaggttatctctgggtgacacaccagtatctgccttctcctcacatctcagaggcctaggagatcatccgaggagcccttcctttcctaaaaatgcaagctcccccgtctgagatgcacctcctgcccggccctctgtataacagtaacacgtatccttttttgaggacttaccacttgccaggtacagggaggcacttcacatgggttcagaacatgcctgtgaggcagggccactgccctcatgctcacagataggaaactgagatgggggaaaggaagcaaagtgatcacccaaggtcaccagcaagttggcggccgagccacttttccatcctctcacccagcttcttccgtgtcccccgcctccccaggtaccggtccgtagtggatctcatgaagtcctggtctgaggagaagtggcattacttgtttccggccccaagggactgtaacccacactgcccctggcgctgcgatggccccacctgctcccattatacccaggtactcctccgtcagggctgagggcccctgggataacacatcctggcgccttagaagaaaaggaatgtgtggagcagaaataagaatgcaaacaaagaccgttatgagcttcttttcaccaaagaggcatattcctggaaagttgtgtgcacaatgaattgaggtgaatcttttttgtttttgttttttgtttgtttgttttttgagacagagtctcactctgttgccgaggctggagtgtagtggtgagatctcggctcactgtaacctctacctcccaggttcaagtgaaactctgtcccccccgcaaaaaattaaaagttatatatatataaagaaagaaaatgactgggtgcagtggctcacgcttgtaatctcagtaacttgagaggctgagatggcaggatttcctgaacacaggagtttgagagcagcctaggcaacagagaaagacctcatttctaaaaacctttctaaaaatagtgaggtgtggccatgcaaggtggctcacgcctgtaatcccagcactttgggaggccaagggggtggatcacgagatcaggagatcaagaccatcctggctaacacggtgagaccccgtctctactgaaaatacaaaaaattagccaggcttggtggcatgtgcctataatctcagctactcgggaggctgaggcaggacaatcacttgaacccaggaggcagatgttgcagtgagccgagattgcactactgcactccagcctgggcaacagaacgagactccgtctcaaaaaaaaaaaaaaagtgaagcttggtggtgcacacctttagtcccagctacgtgggaggctgaggcaggaggattgcttgagcccaggaggttgaggttgtggtgagctatgatcccaccactgcactccagcctgggtgacagtgagacccacctctctaaaaataataataatttaaaaaggaaatgaatagaaaagtatagaaaatatattggctggccaggtgcagtggctcatgcctgtaatcgtagcactttgggaagccaaggtgggcagatcacctgaggtcaggagttcaagaccagcctggccaacatgatgaaaccccatctctactaaaaatccaaaaaattagctaggtatgctggtggttgcctgtaatcccagctactcgggaggctgaggcaggagaatcacttgaacctgggaggcagaggttgcagtgagccaagataccaccactgcactctagcctgggagaccgcgagactctgtctccaaataaataaataaataaaaacattagtgactgtcaaaaaaaaaaagaaaatatattggctagtctgaaggtagtgagttctctcaattgattgtttacagtcagttacagatccaacttccttctcgcgactgcacttgactgagtgcagtatgaaatgaaagaaagaaaatatatcacacatgataacatgataaggctagtgatttgtaaaactcttgttcaaattgtgtgtatgtgtgtgtctgtttgtacacctgtaacaatataaaaattattccttactgttggttgtaataaaaagaaaacattgagaaacatcatgttacaatataaatgcctccgtttcctcccccaacaccttggaacaggcagactgtctctcccaggaagacctcacctaatgcaactgtacaaccccagggagcctgggtcccactgagcccttctcatagccccctctgtctctgtccttcaccagatggtgtgggcatcctccaatcggctgggctgtgccatccacacctgtagtagcatcagtgtctggggcaacacctggcatcgggcggcatacctggtctgcaactatgccattaagtaagtgcctgcaccaaggcaaagagggccctggggccggcgggtgggtcctgagaattcaaagaaagatacgctccatatcccttcttcattctaagtgccctcaataccatataatttgggtagttttaagagtttactaaggccgagcatggtggctcacgcctgaaatcccagcactttgggaagccaaggtgggcagatcccttgagcccaggagttcaagatcagcctggggaacaaagcaagaccccaactcttaaaaaaaaaaattagctgagtgtcatggtgatcatctgtagtcctagatactgggggaggggtgaggcgggagggtcacttgagcccaggaggttgaggctgcagtgagccattatcatgctcactcatgagtgagaaactgtctcaaaaaaaaagtcaattaataatccattttttctttctttctttcttttttttgagaagaggccttgctctctcagccaggctggaatgcagtggcatgatctcagctcgctgcagcctccacttcccaggttcaagcaattttcctgcctcagcctcccgagtagctgggattacaggcgtctgccaccacgcccagctaattgttgtatttttactagagacaaggtttcgccatgttggccagactggtctcaaacccctaacctcaggtgatctgcccgcatcggcctcccaaagtgctgggattacaggagtgagccactgcgcctggcctattttctcttctttttttgagacaaggtctccctctgttgcccaggctggagtacagtggcacaatcacagctcactacagcctcgactggctgggctcaagtaaccctcctcacttcagcctctcaagtagctgggactacaggtgaatgccaccatgcctcgctaattttttgtagagacggtgtctcactatgttgcccaggctggtcttgaactcctaggctcaagcagtcctccttccaaggtctcccaaagtgctgggattacaggcgtgagccaccctacccagcccaataatccttttcctttacccaagtttgagaatcactgggaaatagacaggattgacacaggtggaaagacagtgttgctgaagtcagtagtggagaatgtggcttacatctgccaatacaccagccaactaggcttacaaatatctcactactgaattagacctacacatccagtggcaggtaacactggatagccaaaggccccttcttagaagtacagtgccagccctctaagcttacgacaagaaaaatacagccaagaacacatgctccctgcaggcaggcagatcccaaagaaaaggaaggaggaatgagtgtgcttagcttctccagtttgctgggtgggagagtttaggagatgcctgcatacaagcctcttggaaacagggagcaagcgtaatgaaacttgcagacgttccagattctcatagaaaaacaagaacaggccaggagcagtgtcttacacctgcaatcccagcactttggggggctgaggcgagtgaatcacctgaggttaggagtttgagaccagcctggccaacatggcaaaacctcgtgtctaccaaaaataccaaaattagctgggcatggtggcgcgtgcctgtaatcccagctacttgggaggctgaggcaggagaatcgcttgagcctcagaagtggaggttgcagcgagctgagatcacaccactgcattccagcctgggcaacagagcaagactccgtctcaaacaacaacaacaacaaaaacaaaacaagaacaaattctaagtaaacatgatatttagaatttctttttttcttttttcttttttttttggggggggacgaggtcttgctctgtcgcccaggctggagtgcaatagccagatcatagctcactgcagcctccaactcctgggttcaagcaatcctcccgcctcaccctcctgagtagctgggagtacaggcatgcaccattacacctggctaatttttaacatttttgtagagatggggggctcattatgttgcctaggctggtcttgaactcctggcctcaagcaatctccctacttggactcccaaagtgctgggattataggtgtgagccacccaccgtgcctgccctagaattccaaaattatataataaccacattttactgtcacatagcctttaatcatttacaaactactttcacactatctcattgaagagatgaaagaaagaaggaaaaaggggggaaccctaggaggacattctttttacaaattaagaaattgaggctcaggcaggttgagtaatttaccaaatgtcacaaagccaacaagtagtagagctggttcagaagaatcagtcttttgattccaaattccaaattctttctattgtattattctgatgttcttgaagtcattagtagcctgaaacaaattctcaaaacaggatacttgttatttgttagaaatggcatctattgacaatgtgtcacgttacagcccagctttatcagagacagaaaaatacaagaaaccaaatttcattacaaatagcgtctaatttttttttttttttttttttttttggaggcagggtcttgctgtgttacctaggctcggaagtacagtggcatggtcacagctcacggcagcctcaacctcccaggctcaagttttctagtttgtttgttgacatatcaaatgtttgaagcattgagtgttatcagtatagttgttaagatttttagcctctggggccaagactaccagggttcaaatgtgtgatcttacttaacttctctactcctgtttcttcatctgcaaaatgggaataaaataatacccaatcttggaattgagtgagataacacaggtaatgcccccaggctcataagtgggaaatacagattggttactattgttattaccaggcctaggtttgattcccctctgcaatgcatctactaagcatttgaatacatcattttatcttgacaggcttcggccttccccttccccttcctttctttccttcccctttccttttccctttttcctttcccttttcccctttctccttttccctttctcctttcctttcctttcctttcctttcctttcctttcttttcttctgtccagctctgtcacccaggctggagtgcagtggcagaatctcagctctgcaacctccacgttcctggttcgagcaatcctcacaccacagcctccccagtagctgggactacaggcgttcaccaccacacctggcttatgttttgttttttgtttttgttttttgtagagacgggggtctcgccatgttgcccaggctagtctggaactcctgggctcaagcaatctgcccacctcagtctcccaaagtgctgggactacaggcacgagccaccaagcccagcccctttaaggtaaatgctacctgctcacagaatttaaggattaaaatataatgtgaggccaggtgtggtggctcacgcctgtaatcccagcactctgagaggccgaggcaagtggatcacctgaggtcaggaggtcgagaccagcctggccaacatagtgaaatcccatctctactaaaagcacaaaaattagtcgggcatggaggtgcgtccctgaggcaggagaatcgcttgaacccgggaggcggagtctgcagtgacctgagatcatgccactgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgttttcatttctatatccttctactatagtgattgcaatcctttgtttttttaagcagaacttttttctaagtggttaaattaaacaaaaaaagaactccatgtcatcccaggtatcaccaccacccactctccccgcccccaaacttctgagagcaccttttgagaactgtggactgacagcagccggcacaaatcctgatgttcaataggtgctccagaagtgtttgttgaatgactaaatgattgaatgagtcctgttaggaaaccagaagtgagtatttttctgagcacttcagctgatttcactcatggtcactcaacaatcacgtttggagaaaaaagattatatttctgctcaaaggtgtgttcatttaaggtgagaaaacaaggcactggggcttggcaaagaatgccacaggccagtggtgagattattaggcagccatgagcaagagctggaggaacaattttaggctttgaaaggagaaagagggagaaaaaggctgggcgcggtggctcacgtctgtaattccagcactttgggaggccaaggtgggcagatcacttgaggtcaggagttcgagaccagcctggccaacatggtgaaaccctgtctgtactaaaaatacaaaaattagccaggtgtggtggcacatgcctataatcccagctactcaggaggctgaggcacgagaattgcttgaacccaggaggcggaggctgcagtgagccaagatcgcaccattgcattccagactgggtgacagagcgagactccctctcagaacaaaacaaacaaaaagaataagaaaatcaacccttacaagggagccactaattaactaggcacagtgctaggtgcatacatacatgtgatctttgctgaattccttagagagagaggaggctcttctcttggttttacaggagaaaccaaggcttacaggttgggcacagtggctcatgactgtaatctcagcactttgggaggctgaggcaggaggactgcttgagtccagaagtttgagaccagcctgagcagtatagggagaccccccatctctgcaaataaataaaaaattagctgggcatggtagcatgtgcctgtagtcttagctactcagaagactgagctgagttgggaggattgcttgagcccaggacgtcaaggctgcagtgagctatgggtgacagagcaaaacaaaataaataaataaataaataaaggaaagaaaaaaaagaaaccaaggcttgcagatgtgacttgccccaggtccccagggctggtcagtggcagcgctgagatctggacatctgtgtgaaggttactcacctaatgctcctctgtctccctgggtccttttctcttccaggggcaactggattggcgagtccccgtacaagatgggaaagccgtgctcctcctgtccccccagttatcaaggcagctgcaatagcaacatgtgcttcaaggggctgaaatccaacaagttcacgtggttctgaattttctctgggctttggtgcgcctccagctgggcctgaccctccatgtcctgccctcaaaaaactgggtggagaaataattgtttctttaaaggatatgagttagaatcaccccctgttgaattttccctcctagatccccttcttaaatgtccaacatgggtcaaaagaaaatgacctccttgccttccttctttcctagttgcatctttcttttcttgggcctctgggaaagagccctgcatctttcattaattcggttctcagagaaccaaggctggaaggcatagaactggcaccttgggaccaggcataatggctcacacctataatcccagtattttgggaggctgaggtgggagaatcacttgagtcctggagttggagaacagcctggaaagcctggcgataccccatctctatttagaaacaaacaaacaaacaaataaaaaacctggcacctcggttttgtaactctcaggctttgtcaaacccaaatgactttgtccatccaatgaaaggaattccactgggtgcggcggctcacaccggtaatcccagcactttgggaggctgaggcaggtggatcacctgaggtcaacagttcgagaccagcctggccaacatggtgaaactctgtctctactaaaaatacaaaaattagccaggagtggtggctcgcgcctataatcgcagctactcgggaggctgaggcaggagaatcgcttgaacctaggaggcggaggttgcagtgaacagagatccagcgactgcattccagcctgaggacagagtgagactctgtctctaaaaaaaaaaaaaaaaagaaagaaagaaaggaaacccgctttcattcgtctcataacagtcaaccagtttctgggcagtctttgaggactcgtgattcgctccctgagttgggcacatttcaggcccatgattttgaaaaacattgaaattggcttgtggacatccgcccccccacccccactgcatggtactggagccacgacagagtccaggcccccctttttacagatgggtacactgaggctcagagcagggtgtaacttacccagagctgcacagcttgtctttgatggccaaggttagagctcagtctctcacagctccttcctgcttcctcggctctcagaactgagaagtgaaaaccaaagttggcctgaggggactctctctgggcctttttttctctatctctgcctcggtctctctctcttttgtctactgtccgttctatctctgcctgtttttgttttggtctctgcatctctgattctttttctcccatataatcttactctcattccaataaaccatttcccctctccccccaccatcccacccagggatcatagcacacaaaagtccttttgtctccagagatagtaaaatctcctccctcagaccttgccctgcagctggggcccactccctgcctggctggagagcttttcctttgaagacccgggatggaaaacaggcccttttccatggagtccctacgttgtcctggatggaatgaattttctcatcctgtgcatgtcaccccctcccattccacccccaataaagtcttttgagatccagtgtagtggctctttctggtccctccctctcttggctcccaagagggtcaaaacacaaggaatgggaactgggtgggggaagatgggtgagaggaaaaccagctcaactggaagaccaggggaaggaactaacagcgctttgggccccgctctgcagaaggctagatcaatgcacaagtgcatgcacgtatactattgctccactttacagatgagataaatgaggcatggggtgagtactagcttccaaatgctggaaatgagtgaaataagagaattaagaggttgggcgtggtggctcatgcctgtaatcccagcactttgggaggccaaggcggcagatagcttgaggccaggagttcaagaccagtctgggcaacacagtgaaaccctgtctctactaaaattacaaaaattagccaagcatggtggggcacgcctgtaatcccagctactcaggaggctgagacaccagaattgcttgaacccaggaagtgaaggttgcggtgagccaagactgcaccactgcactccagcctgggtgacacagcaagtctgtgtctcaaaaaaaaaaaaaaaaagagagagagaattaaggacactgttgtgagttcattgttcttagactatatctttcctactttattttttggaatgggctctcgaaggcagtatcagaaatggaaaaccgaagagatcacgtggaattcccaccttacagtggcacttttggcttgtctcttccctggcacagtggctcatacctgtaatcccagcactttgggaggccaaggaaggtggatcacctgagttcaggagttccagaccagcctgaccaacatggtgaaaccccgtctctactaaaaatacaaaattagccaggcgtggtgctgtgtgcctgtaatcccagctacttgggaggctgaggaaggagaatcgcttgaacccaggaggcggaggttaaagtgagccgagatggcgccattgcactccagcctggacaacaagagcaaaactctgtctcagaaaaaaaaaaaaaaaaaaaagaacagatttaatgaaacttcttgaatcccagtttttacatctgtaaaatgggaatattgacagtgacaattcaatgacgttaagaatatacaatgctgacaaactaaagagttcataaatgccagtggttgtcatcctcattatcctggtgctcaggaaggcaatgtgagacctgttgaaatagcacgggctttggggtcagatgatgctgaattccagttctgtgttggctccttcgtagttatgtgacctcatgacgccacttcatgcagggggttacgtaccacttaaatctccagaacattttgggaaattgacatagggttagcaaacctcccccacccccatataaaaatattaatactttttttttttctgagatggagtctggctctgtcgccaaggctgcagtgcagtagtgcaatcttggctcactgcaacatttgcctcctaggttgaaacgattctcctccttcagcctcccgagtagctgagattacaggtgctcgctgccacacccagctaatttttgtatttttagtagagatgggattacaccgtgttggccagcctggtctcaaactcctgacctcaagtgatccacctgcctcagcctcccaaactgctgggattacaggcatgagccactacacccgaccaagaatattaatacttttttttaaaaaatatcgaagttatttatttatttatttatttatttatttatttatttattttgagatggagtctctctctgttgcccaggctggagtgcagtggcacgatcttggctcactgcaacctctgtccccctggttcaaacgattctcttgcctcagcctcccgtttgccaccatgcccggctaatttttttatttttggtagagacggggtttcaccatgttggtcaggctggcctcaaactcctgacctcgtgatcggtgcgcctcggcctcccaaaatgctggggttacaggcgtgagccactgcacccggccccaaaatctaacgtttgttatcactgttgttttagaaaagaaaggacattttaatgcaacccatgcccatctgtaggggctgaaggtccctctgaggtgattgataaagctgaaaaaagagactatgggaagagaagaggaatattatcaattagctattttagaagcagggcaaactatgagctaggtattcctataaggaaatgaaataatttactaaaaaacatacagcaagaaaataatagagctggagttttctgatttttctgagtccagaatttgtttcactgttctcatttcagctctctctaacaggatgaatgaccttgatttcagaatccccaagcaggtggtgagatccaaaactgagacaaaagaaacggggctgttccaaaaaaaaagctaggtggcaggtgtctaacatgccagggagctaaaacagagtgtgtgagtttcagcagcaggttgaatttagaatggggaaggagaccagaggagacgccagacaggatgactttgtcccattggcctggaggcagccccatgtttctccacccctcatatcactcaccagtttgtaatagtatctttgaatgacgatctgattaaggtccgtctcctccattagtccacaagtttcgggggtacatctactttgctcatttccatatccccagagtctagcacaaggcctggtacatagtaggtgctcaataaatatgttagatgaaaggaagataacacctctatgtactagcagtgagactccaggcatgcaatttctctctgtccttcagtcccttcatctcaaggtttaatttaaatatggtaacgcctgtatgcaactcccagcatccagtaggcactcactaaacacagttctccaccctccttttttcctctgcccctccctcggttttcccactacttcctgcatggtgacacacccatagtttggagccataaaacccaacccaggttggactctcacctctccagccccttctgctccggccctgtcctcaaattggggggctgatgtccccatacacctggctctgggttcccctaaccccagagtgcaggactaggacccgagtggacctcaggtctggccaggtcgccattgccatggagacagcaacagtccccagccgcgggttccctaagtgactggttactctttaacgtatccacccaccttgggtgattagaagaatcaataagataaccgggcggtggcagctggccgcactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacggtaagtggggctgggggaagactggacagggcgggactgcggtcagctttgggaggccatgggacacctccccgtgtgtttcttacgggcccaaagctcctcctggagctcctctggaagggcaggaagccccacggaggcaatgtgaccgcttccctaagctctcaagccggggcatggcctgcttggtgcgagaagtgctgggaggggccgagaagccctggggcagaggcttggctcattttgtctgtccagaggccttcctgggaatgcatctcaggggtctttccaaaaccccacagagggtggggcttggaagcaccgtcctgtttcgatgcggggcaaattgaggtccaccaggagaggcttgctgggcctaggtcacgttgctggtgcattatcaagctgggcgtgggaccgggcagctcggtcgctccgcacctccgttggctctggataatggggaggaggtagaaagcgccgcgcagggtggagcgttggaaaatgagaatatcttgtgcggacgtgtgaaactcagatgcagggctagaaagcatgtgttactgagagtgaaaggctcaggctcactccttagggtgacccccacattggaagcaacccaatgtccctcagcagagggaagacgggtaaataaagcgtgagacgtctttacagtggaatgctatcccattgttcaaggaaacaacgcacatctgtgtgtgacagggaagaacctctcagttaaattaagtgaaaacggtacactgaagaactgtgtagttgctgatagcgaaacggatatagatgtatatatgtacacacgcgtatacgtgtacattccacgcatagaaaattcgtggaatgacacaataaaattggtgacaggtttgtttctgaggagggaaattcaagagaatgttttatcttttggggacacattttggattttttaaaagttgggtgccttttataaacctgttcaaatcacacacccgcacagaacttggtctctggaatccagcagacctcggggtctagttgtgactctgtcacacggctcaacattcacgtgcctcttgctttctttctgaagtggagacaggactaggatgtgtcttaagatcatggtggatgccgtggggaacaaggatgtaaagcccttgataccacgtgcattgcaaagacacaatcaacatttatgtcatcaattgctgaggacagagggccagggaatgacagaatcagggcctgatctcctgactctagtcaggaagaatcttctttgctttgacccccatcaaacaggaatatgtgatgcactggaaatggcagaggctgaagaaaccaacagcctgggaacccatcccacacaccagctgtgtgaccttgggcaagacatttcccctctctgaacctatttcctcatctgtaaaatgaagataacaacaggacctatctcccagagagcggggagattagaggagatagcatagaggagattaagggtgaggccacccttaatccacaattttaagacctggagtatagatgccaatggatgacttggttgaacctgtggctaggggaagacattgtctctcaaaggggccagacagcttctggggaaggacagcccaggtcataaggctaagctaggggtgaacagaaggccccacagtgtctcttaaaggatgatacaataatataacctgacagcctttcactgtctcccacgtctctgcaccttgtaggatgtcctcatgtctcttcatctctgctcctgtgtcatactcattatatagcaaacattcagcaattattagaatggttgcttctatcgacaggtaggtgggtgaatggatggatgaatgggttagtgaatgttctactattatctctcagacagctgtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgaccttgcagtacatccacaaaaaatgagcacttttgtcctggggcagtggaacattcactgcagtgtatgtgtgcctatgtgtatgtgtgtgagagtggctgaaagaccctgatttgatatttttgataaaatacacctgggttagcatcctagatctaccttatttaaaaaaaaaaaacaaaacaaaaaactgtgtggtcttgtgagtcaaatcattacccctctctgagcttcacatgttttatctgtaaaatgagctactgaagtctgctggaaggctccagaaaaaaaaaaaaaagaaaagaaaaatttgctttctgagaaaagaaacaagtgctccgaggaaacaaaacccctctcccaggctgggtgcagtggctcacgcctgtaatcccagcactttgggaggctgaggcgggcagataacttgagattaggagttcgagaccagcctggccaacatggcaaaaccccgtctctactaaaaatacaaaaactagccgggtatgatggcacacgcctgtaattccagctacttgggaggctgaggcatgagactcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcagggacatggcacatagcagagcctcagttagaggcagaggaagacatggctgttgtgaggatcaaatggaaggatccatgagtgcttagaacagtcctgggtccagagcaagcacgcaagaaatcctcgttgtggtttcatgtttttgagctttagcaggattctaaagagctgctctttggtgtggtgatgctgggtggacttggccctccctggacttccggtgcttccacggcacactggttttggctttgcggttctcgtcatcgctctgatcagatagttgctggtgtgaattgtggtgtctggctgccccaccagactataaactccgtgagttctgggacctgggtagtttgttcagccttgtttgtctcactatgtctcacatggtgactggcacagaagaaatgctcaataagcatttgttggatgagtgaaatgatgggcttaaaacagcgctacaatgatgatcatcaatgtcagccagatcccactctcttgccttccttcctctctgccctcctcactgcgttgtctttggtccttgtatttgccccattataacccaaactggctgtcccagcttcagctgtcatgtctgcacttacgtgtctgaagctggaggcaggaggagaagaggttttcctcagtgcccttgtttcttttatccaaaagcaaaacttccccagaaacctcctggcagactcccctagttcaaggaaagctgggaagacaagtatgtagtggaaagagatgggaaagccaagatggacctagaccagtgatttttctcttggggtgtggcacactcctgctccaaacagaactgaggctctggtataaatgagtttctcagcctcagcactgttaactttctggcctggaagattctctgtggtgaggggctgtcctgtgcactgtaggatgttaagcagcatccctggcctttactccccagatgccagtaacatctcttcccatcagttttgccaaagaaaaaatgtctccagaaagccaaatgtaccctggggcacatataaccccactgtgttataggagaacaaggtagttctggggagtgtctaccacaatggagtagagtagactgtgactcttgtgttgttctgctttgagtgccaggatcttgctcagtgccaatctggtactaccctgagtaactctgaggatgagatgctaaacatgcatatctgtgtgctaacctgactcctggccttattacttttctacccttattttccctttaacaagtttcccttggttatttattttgcttctttggtagttgctcatttccgtaagtacctcgaatctccttaaaggaaaggtctgtatctatctcattctttttgttatagtccagccttccacagggcctgatcccatgtagaccttgattgaagattaattaagtggatgaatgaatgggaagatggatggatgaataaatgtatgtttaggtgggtggataggtgaatggactgatgaatgaatgtgatgtgatgaatggatgtgatagatgggtggagggatgcatgaatggaatagagggagaaatagctggatggatgagacaaatgaatgagtaactggggagatggctgggtggatagatgggtggatggattaataaaaagatgttatgggtggatggttgggtgtggaggatgatgcatggatgggtaagtagatggatggaaagatatgtaggtgcatgtgataaatggatgaataagtagctggatagatgggtaggtggttaggggaaggatggatggacaaatgatgtgatgagtgggttgatgaaaagatggatgaatggatggataagaaggggtgggctgaggtagcctggaatagcagcatcttcaagtgctctaaacaggacaagtgaagagataggggatgtcaacaatcttccatcagggcaatactgtatatctgtttttaagtgccaggtgagcctaatttttcctagctatgtaggcctagtccctttgaccaatagcatcagcttgaggacagatcagaggccattgtcggagacagtttggtgatgtggctctgccccttgaagctctatgatgatggtgctttgcttcacttctctggtcctcagtttcttcacccatcaaatgagccttggttgttgtgaagattccatgagctaatgaaagagaaaaggtaatagaagctataacaaacatgccgtgtccttgtgaagggtggataggcccaaaatcgagtaggaccccagatgctggctggctatgggaccgtgtccaatatcaggctatggctgttcccacccttcattcttaaaatatggcccctctccagcccttcccctatctcccctcccacatcaccttcccatcctacgtcaattcagtcttcagcccctatgattcacaaacctggttgcacataggaaactttttaaaacaattttggggctccactccagacccagtgaatcagtctcctggggtgagttccaagagtctgtaattttttgagctccttgtgtgacttagggtatgcagttcagttgaggtatggaaaccattgccttactttctcccatttagtaaacagaggaactaaatatccagagtgcatcttgcctcaacccagaagcctcccgtattcattaattcattgttcatttgttcatttcttcaacaatcttccactggaggcttatggtatttaagacattttgtaaggcactggggaaacacaggaggataaaactttgcttcacgtggtggctcatgcctgtaatcccagcactttgggaggccaaggtgggtggatcacctgaggtcaggagttagagaccaggtagaggcagaggttgcagtgagccaagatcacgccactgcactctagcctggcgacaggagtcagactatgtctcaaaaccaaaccaaaacaaaacaaaaccaaaaaaaaacaacaaaaaaaacaactttgcttcagatcttaaactgtgctcagtttggcaggaggacagacaagccagcagcaaccaaagacagagtgccatgataaggacagcaaaggcactgtgggatacagagggacttaggagaaggggaaggggtcacagacttcttgaccttggaggagtagactgatatctaagctggaacctcggtttagcaggagtcagccgggagaagagacggtggggaagagtgttcccagctgagggaacagcatatgaaaaggcctggagcctggccacacactgctctgattttacttatatttgactgcaattaattccatcctttactgaaagtatcttgagacttgtctggttgtttcatgattgattaatcttattcctaaaagcatgctgaggctgggcatggtggcttattgtggattacacgcctgtaatcccagcactttgggaggctaaggcgggtggatcacttgaggtcaggagttccagaccagcctagtcaacatggtgaaaccctgtctctactaagcatacaaaaattagctggacgtggtgccaggcgcctgtaatcccagctactcgggaggctgaggcaggagaatcacttgaacgcaggtggtggaggttgcagtgagccgaggttgtaccactgcactccaacctgggcaacagagggaaacttgtcttaaaaaaaaaaaaaaaaaaaaaaagcatgctgagatgcttaagtgaaggaattgtgccttccatttttcctgactcatatgcctgtagcataaggatgggtcaatgataacgaaaggaatttgttttcatttaagccccttttatgtaatgggcaagatgttggctatttgatatgttttctcccttttaagccttgcaataacccatccaagtaggaaatattatctccattttataaacaaagaaattgagattcagagttgttaagtcacgtttccctgcatcgccttgcaaataggtgattaaaatctagtctgacaccaaatcttcattctttcagctattatgtcataatagcatccaaggagtttaccaccttctaccacctactagctgtgtgaccttgagtgaatgactcaattctcttttttttttttttttgagacggagtcttgctctgctgcccaggctggagtgcaatggtatgatcctggctcactgcaacctctgcctcctgggttcaaacaattctcctgcctcagcctcctgagtagctgggattgtagctggggttacaagcgcctgccaccatgcctggctaatttttttttatttttagtagagatggggtttcaccatgttcgccaggctagttttgaactcctgacctcaagtgatctgcccgcctcggcctcccaaagtgctgggattacaggcctgagccactgcgcccggccgacccaatcttttttgcctcagtttcctcatctgtcaaatggggttgatgataataccatttacttcacagggttgttgtgagacataaagtcaatatttgtaaagtgctgagtgtctagcacatagaaagtgctatgtgaatttgaacgattattattattatacctatagtgtgtgcatctactatatgcaaaggactggatgcttactaggtgttagcatcattttggctgttgtagaaacaacagagatgagtaaggaatagataactggtcccaggatgcaactgtctctggctggagactaaggacaaggctttgttgcaagccttctggggccctgggatgcccagggtctcctcttgggggtgctggttcatagatgggggcctgtgtggctccttcacagaggaggaggcagatgagaggcatagaaagggaggggacagacctatcctcatcagagacctgggagatggctctggccctggccctgggtagctgtttgtgacctcactcaagtccttctcctgctgtttctccatctactcttttttttttttttttttttttgagacagagtctcaatgtcacccagtggctctatctctgctcactgtaacctccacctcctgggttcaagcaattctcatgcctcagcctcccaagtagctgggattgcacgtgtgtgccaccacacctgacaaatttttgtagtcttggtagagatgggtttcaccatgttggctaggctggactcctggcctcttgtgatcctcccacctcggcctcccaaagtgctgggattacaggtgtaagccacagcacccagcctccatttcctcttttgagaaatggaggtatgacaaccatctggctcagccattgtcacacagtattccctgggtcctaagagtcaggaaagatgctgcagggttccctttgagggtaatgtgggtagggacgtgttcaaatggactagggcttagcctctccccacccttcaacctctggctccatcagagacacttctttttgacttttgtatatttctttttattttattttagagacaggggtctcgctatgttgcccaggctagcctcaaactcctgggctcaagcaatcctcccgcctcagcctcccagcccctgggattacctgctcatgccactgcacccggcactctgttttgacttttaaatgaaatatttaatggagggtctccacagttcaaaaatatttggaaaatcagaagaccacaccagtgtgtttcaaactgcaatcttaacccaggaataggtcatgcaattttttttttattttttttttctagatggagtcttgctctgtcacccaggctggagtgcagcggcacgatcttggctcactgcaacctccgcctcctgggttcaagcaattctctgcctcagcttcctgagtagctgggattacaggtgcccaccaccgcggccagctactttttgtatttttactagagacggactttcaccatcttggccaggctggtcttgaactcctgacctcgtgatccacctgccccgacctcccaaagtgctggggttacaggtgtgagccaccgtgcccagccggtccttcaatttattgggattatattagttcagacaatatagcttatgtaacaagcaaatgcagactttaagttagaagtttattgacctctgtggcatagtcatccagggacccctaaggtcaccctagcccagaaagacactttcacttctactcacattccattggtgagaactagtcacatggcccttgccaaatgcaagggggtctggaagatgtggtccctagcggggcgggactagctgtaaagtttgtaaaggggagcgtgaattagttggtacacagttgatcgtctgtgcagtagggtcatgctcacacgtccctccacacacacacgttaaatatgtataacaagtgtaaatatacaatttaaaaaagtatcttttttttttggtttgtttttgttttgttgttgtttttgaaacagggtcttgctctgtcatgtgggctacagtgagccacaatcatggttcactgcagcctcaacctcccaagctcaagcaatccttccatctaagcctcccaagtagctgggaccacaggtgcatgccaccatgcccagctaattttttatttttatttttttgtagtgacaggtcttgctgtgttgcacaggctggtttcctactcctgtcctcaatcttcctgcatcagcctcccaaaatgccgggattacaggtgtgagctactgcacctggcctttacaattttttacataaaatgtttcaataaaaaagtgcatagatagatacagagatagcaataaagcaaatgtgacagaatgcaaccagttggtgaatttaggcgaagggatacatcagtgctcactatactagtctttcaaactttaaagtttgaaatttttcaaagtaaaatattggagaaaatgaaattcttaaaatttactagacctataagtagactaaaacaataagttataactaaagtaagatttggccggacgccgtggctcatgcctgtaatcccagcactttgggaggctgaggtgggtgaatcacttgaccccaggagttcaagaccagcctgggcaatatggcaaaaacccacctctacaaaaaacacaaaaattagctgggcctggtggtacacgcctgtagtcccacctactcgggaggctgaggcaagaggattgcttgagcccaagaggtgaaggttgctgtgagccgagattacaacaccacactccagcctgggtgacacagcgtaatcctagtgctttgggaggtcaaggcagaaaaattgccaccacacctggacttaaaaaatatttttactgaagtataacattcaaaacagaaaaaggcacaaatcatcaatgtatcgctttatgaaatttcacattttaacaaaagaatgaaataaaataaaatagaaaatatcatagagcatttcatgtagtaagagtaagatatgtatgtttttgaaacttttgttttatttatgtatatttatggatttgtgcttgatgttgtgataatagcaaaaatttatagagtacttactagggttttacacatattaactcctaattctcaaaatgtccctattggccgggcgcagtggcacacgcctgtaatcctagtactttgggagcccaaggtgggcggatcacttgaggtcaggagttcaagaccagcctggccaacatgctgaaatcccatctctactaaaaattcaaaaattagctgggcatggtggcacgcacctgtaatcccagctactcaggaggctgaggcaggagaatctcttaaacccaggaggtggagattgcagtgagccaagatcacgccactgtactccaacctgggcaacagagcgagatcctgtgtcaaaaagaaaaaaacaaaaaaaacagcatactttgtattaggtgaacccacaaagtacaggggccaattgtaggtagtccacaaacacttttaaatctttgtgcatttattgtatgttagaaaaatttatacatagcatattaaagcattaatataaaatatcttttaaaaattaaggtatatcttcaaaagaaaggaaaacatcaagtaaacaattatagataaataaagtacaggtaaaaggcagatgtggtaacaattgtatgaagaggaatacaagtgtctagggcttgggggccacacactaaacctggcatcagaaggcccagatctgggacccggctcatttgttttctagcactaggttgtttttcatccttgtataacaccatggcccaggtactactctaagcactttataaaaattaactcctggccgggtgcggtggctcacgcctgtaatcccaacacttttggaggccaaggtgagtggatcacctgaggtcaggagttcaagaccagcctgaccaacatggagaaaccccatctctaccaaaaatacaaaattagccaggagtggtggtgcttgcctgtaatcccagctactcgggaggctgaggcaggagaatcacttgaacccaggaggcggaggttgcggtgagccgagatcgcgccattgcactccagcctgggcaacaaaagcgaaactctgtctcaaaaaaaaaaaaaaaaaattaacttcttggccaggcacggtggctaacacctgtaatcccagcactttgagaggccgaggcagacagatcatgaggtcaagagattgagaccatcctggccaacatggtgaaatgccgtctttactaaaattacaaaaattagctgggtgtggcacatggctgtagtcccagctactcaggaggctgagacaggagaatcgcttgaacccaggaggcggaggttgcagtgagccaagatcgcaccactgcactccagcctggtaacagagcaacactccgtctcaaaaaaaaaaaaaaaattaactccttggccagacatggtggcgcacacttaaatcccagcactttgggaggctgaggcaagaggctcacttaaggttaggagttcaagaccagcctgagctacaaagtgagaaaataaataaataaataaattactcctttaatcctcacaaccgtctattgaggtaggtactgtcatcatacccatttctgagaaaacaaagtctcagagagactaaatagcttactcaaaaccacgcagcgcatgagaggcggagctagaattcaacatcaaggattgtattagaaaaggcaataccagcttatcaacccaaaacacgagaggagagtttatctctccttcacgcagttgtccagggtccccaactccttcctccctagatggaagatgggctttttttttttgagacataaatatatatatatatgtgtgtgtgtgtgtgtgtgtgtgtatacatatatgtgtgtgtgtgtgtatatacatatatatatatatatatattttttttttttttttttttttttgagacagggtctcactctgtggcccaggctggagtgcggtggtaccatcttggctcatcacaacctccacctcctgggttcaaacaattctcgtgcctcagcttcctgagtggctgggattacaggtttgcattaccacacccagctaatttttatatttttagtagagatgggattttgccatgttggccaggctggtgtcgaactcatgacctcaagtgatccacctgcctcggcctcccaaagtgctgggattataagtgtgagccaccaggccctgccaggaagatgggttttatttgaaccactgggccctactgggatgggtagaattttctgtatcattctgggatccacatcctcctctgaaaatggggttaataatgctagttctatttacccctcagggtagctctgctgctcaaggggatagaggcaagagtgtcctgcaaactgcaaaaagttccttgaatgtaaaatgttagtatgtattgttaatgatattgaccaaagctacattaccatgttacagtgaagattaattgaaacagtgcatggaaagaccttggttcacatacagacaaagtcagctgtgagtaatagccataatagtaatgtggttatgcaatttaaaatattgatttatctccaaattgggatatagttgtataggatctttcttactagcaagttaacacattacgtctataactaaaaaatcaagaagtcttgatttcttgagaagtcagtataaccatgatgtttagaaatacaaacaagaggctgggcacggtggctcacgcctgtaatcccagcactttgggaggccgaggcgggcagatcacaaggtcaggagttcgagaccagcctggccaacatggtgaaaccctgtctctactaataataccaaaaaaattagctgggcatagtggcgggcacctgtaatccctgctactgtggaggctgaggcaggagaatctcttgaatgtgggaggtggaggtttcagtgagctgagatcacgccattgcattccagcctgggcaacaagagcaaaactccatctcaaaaaaaaaaaaaaaaaaaaaaaaaaaaactgggccggccacagtggctcaaaatgctgtaatcctggcattttgggaggatgagtggggggatcgtttgaacccaggaggtcgaggctgtagtgaacaaacatcatgccactgcactccagcttggatgatagactgagaccctgcctcaaaaaaagagaaaggaaaataaataaataaatgaaaatttaaaaggaaaagaaaatatttaaacgctatttcaaacaatctcaaatgtacctggaaacagttgggacaggaagtcatgaagggaatggggcagagttagagaaggtcagagtacagccatgtttcacatcccagctgaaactcctccaacagctttgtatcgcccttcaaatacaacctgagctctttttctttctttctttcttttgtttttctgagttggagtctcactctgtcatccaggctagagtgcagtggcatgatcttggctcactgcaacctccgcctcccaagaagctgggattacaggcgcgtgtcaccatgcccagcaatttttgtatttttaatagagtcagggttttaccatgttgccaggctggtctcaaactcctgacctcaagcgatttgtccaccttggcctcccgtgagccgccgcgcccggccctgggctcttttctttgaccaaaaggctctcacaggctctgactcttgtctgatggtctctcgtctttctccctttggtcactgcagtcagccacactggacttttgttttttttgtttgtttgtttgttttgcgacggagtctcactctttcacccaggctggagtgcggtggcgcgatctcggctcactgcaagctccgcctcccgggttcacgccattctcccgcctcagcccccccaagtagctgggactacaggcgcccgccactgcgcccggctaattttttgtatttttagtagagacggggtttcaccgtgttagccaggatggtctcgatctcctgaccttgtgacctgcccgcctcggcctcccgaagtgctgggattacaggcgtgagccacaacgcccagccacactggccttttgacaatccttcaatcacgccaagcacactcctgccattgggcctttgtacttgctgttctctctgccaggaatgcctcttccccagatctttgcatagctgatttcttctcattgtcagggccttagttcaaatgtcctccactcagagcagcctcccttgaacacccaaatctaagcctgccccacctccatcccttgatagcaattccattatcctctacagcgctgaaattacgtattccttgatctgtttatcatctgtctccttcacagaagttccatgacagcagggagttaggctgtcttgtcccctgctgtatccccagcatgtagaacagtgcttgacacacagtaggcgccccataagtatttgcggaatgagcaaatacagatggggacagctgagtcagtagggtgagcagctggatgggccagtagtggagggaggaaacggcagcctctgcctgggccttgccctgggtaaacagacctctctctccccagacagccactgtttgacgactgtctgccatgggcctggctgagcctgggccgccaaactgccaacgcctctgtattctctgggacaagcagtggaggcagccatacctccagcagagtttgtgaaggagcaggtcagaaagttgtcaaaacaggcatgacgaagggcagaggaggtggggagacagggagagagcaggcggccctgccctgggcagagccagagaaactggagggaggcctgggtgctcccctgggcagcttcccaggcaaacccagctgcctgcagggctcagcgctgggagcaggttgtggtcccagctctagccctgacacacacaggatctcaggtacttgacatttgtaggccttagcttccttacttgtaagttagaggctatgggcagattagtggctttcaaacaattttttttgttgttgctttttgtttttgagacggagtctcaatcttgtcgccgaggctggaatgcaatggttcgatctgggctcactgcaatctccgcctcccaggttcaagtaattctcctgcctcagcctctggagtagctgggattacaggcgcgtgccactactgcccagctaatttttgtatttttagtagagacggggtttcgccatgttggccaggctggtcttgaacacagcaagattctgtctctacaaaaaatacaaaaattagaggctgggcccggtggctcacacctgtaatcccagcactttgggaggtggaggtgggcagatcacttgaggtcaggaattcgagatcagcttggccaacagtgggaaatcccatctctactaaaaatgcaaaaattagccaggcatgctggagcacgcctgtaatcccagctacttaggaggctggggcaggagaatctcttgaacccaggaggtggagattgccgtgagccaagatcgccactgcactccagcctgggcgacagagcaagaccctgtcaaaaaaataaattaaagaaaatcccaactttcacctcctttaaaaaaagtgaaggtctagcaacactgatacctatgagacaacagtctcctggagccactttagattctcatgcttcctctaatttgccgtagtccccactattccttagtgtccccatacggaaacttattaatgaacataaatcaccatgtttgctgtattgtttttcttagaggaacgtgtgaactttgctcacaccctatctgttccatttatttcagttacttctctgggtattgagggcacttgagtgtgggacccctgatcactgagaccaaagcagagttcatttatttgcacgagcaatcttctatttcatagatttaccatgtttttaagtgactacaagaaaagtttaaattatgtctgtggctcacattctatttctattggccagcactggccgggtccctcagattctatagcagtgtacgtgtgcttgctgctaactcattctgcctccattttccattcttgcgtagaccaatcccagtcaaatctcttgggctggtgtcttctccccaccccacagttatctttggtgcctccaccctggttagctggccacctgtctgtccagaggatccaggctccagaactccaggcatgtcttctagaattctccacatgggaaatctcactcccaggccccatctggcagccattgtgttttctttatcagacattcacataaaacaatagtcaatttgaaagctaaatacacatccattcttctgtctccagcctgtaaatttaccccaaatccagtaatttgggaggtggagttggtgggaagaggtttttttttccccctcttctccagggcaagtcatatagtttttctggagatgaggtggactgagtttgggggaagaacacaggtccatctacagtgaaagcgctgactttgtttttggagaagatggtgtcatggcttctctggggagatgagatgagggaatcctgaagacttagggggccgggaggaaaaggaatcttggcaatgatgaagacaccttcaaatgaaggggctaatagggtagtggctgagaatttgtgctgcagtcgggagggcttgggttagagctacatccacagtatgaccttggacaggtgactttatctctctgatcctcagtctcctcatctgtaaaataaggataagaatagacttgacttccacttcaacgagaagtgaaacgagatatcctaccactgcgctttgcacataaaggctctataaatgtcagctgtcatcataaagagccaaaagtggcatttggagtaaatctgatttgtttttaagagatagggttttgctgtgtcacccgggctggagtgcagtggcatagtcaaaacccactacagcctcaaattcctgggctcaagccatcctctcgcctaagcctcacaagtagctgggactacagacacacaccaccatgcctgtctaacgtttactttttaatttttttaagttttaaaattttctgtagagatggggtcttactgtgttgcccaggctggtctcaaactcctagcctgaaatgatccttccaactcagcctcccaaagcactgggattacaggtgttagccaccacacccagcctagtttaattcttttttaatcatccttctctgcatttttgtaattcctctaccatgaacctgctttagttaagtaagaaacagttaactgggggaggagaaataaaaccaaacccctaaaaagcccctaataaacccctaaacgtggggtccaacatgaggtgttatggctgggaaaaggtaagagatcaaactatacacacccttttttttttaaattaaactttttagttttttcagagacagtcttgctccattgcccaggctagaataatggcatgatctcggctcactgcaacctccgcctcctgggttcaagcaattctcctgcctcagcctcctgagtagctggaactacaggcacgcaccaccatgcctggcttctttttgtatttttagtagaggtggggtttcaccatgttggccagcctgatctcgaactcctgacctctggtgatccacctacctcagcctcccaaactgctgggattacaggtgtgagccactgcaccaggccttaattaaacttttattttagattcagggggtacatgtacaggtttgttacatgggtatattgtgtgacactgaagtttaggctatgattgagctcatcacccaagtagtgagcatagtacccaacagagagttttttagcccttgcccttcctctagaagtccgcagcgtctattgttcctctcttgatgtcaacgtgtacccaatgtttagcttccttttacaagtgagaacatgcagtatttgtttttttgtttctgtgttgattcacttaggatgaggtcctccagctccattcctggtgtggcaaaggacacgactttgttcccttttttatttttttgacactgtccttgaacttggttgaggttttgttcccttttatggctgcatactattccatagtgtatatgtaccacattttcattatccattccactgctgatgggcacttaggttgattccatgtctttctactgttttgttttgtttgagatggagtctcactctgtcacccaggctggagtgcagtggcgcaatctcagctcactgcaacctctgcctcccaggttcaagccattctcctgtctcagcctcccaagtagctgggattacaggcatgtgccaccatgcctggctaatttttgtatttttagtagagacacagttttaccatgttagccaggttggtctcgaactcctgacctcaggtgatccgcccgcctcggcctcccaaagtgctaggattacaggcgtgagccactgtgcttggctgatgtctttctattgtgaatagtgctgtgtagaacatataagtgcatgtgtctttttggtagaagaattcattttcctttggttatataccaaatcatgaaattgctaaattgaatggtggttctgttttaagttctttgagaaatctccaaatagctttccacagtggctgaactaatttatattcccaccaacagtgtataagtgttcccttttttccacagccttgccaacatctgttatttttttgactttttaatgacagccattcttcagatatcaagggtggggacaaaaaaagaaacttaataatcattttgactagtgtgagatggtatctcacgatttcatttgcatttctctgatgattagtgatgttgaacattttttcatctttgttggccgcttgtacatcttcttttgagaagtgtctgttcatgtgctctatccactttttgttggggttctttgttttttgcttgttgaattgtttaagttccttgtaggttctagctccttgtagaattgctaagttccttgtagacctttgttggattcagagttcgcaaatattttctcccattctgtaggttgcctgtttactctgttgatagtttcttttgctgtgtagaggctctttagtttaattaggtgtcacttgtcaatttttggttttgttgcgattgctttggaggatttagtcataaattttttgccagggaaatgtttttgttttttttttttgagacagggtcttgctctgtcacccagggtgttaataacttaacaaactgagaccccaagaggaaaggtgattcggccaaagtcatacagtaagttagtggcagagccaagactagaatggtggactgtgggtgttggaagggaactttgaggttgttagggcagcctttcctaaggcgaggcccctcagacaagaaggattctattgttagatgtttgaaaactgctgaattaaagaaagctgcacaaatttcattatccgagaacttctcagaattcttaacacatgacaataccttggccactccaagaaatgcctgcagtgtatagggccctgaattagtttcaagagtcccttgaaggacattgacacctatgcaagctctccctgctctcagacagagaaatgctatatcttagatatactcctagttgcttttaaaaaataggattctagggccgggcatggtggctcatgcctgtaatcccagcactttgggaggttgaggcaggcggatcacgaggttaagagtttgagatcagcctgaccaacatgatgaaactctgtctctactaaaaatacaaaaaaaattagccgggcatggtaattagccgggcatggtggcatgcacctgtaatcctagctactcaggaggctgaggcaggagaattgcttcaacccgggaggcagaggttgcagtgagccgagatcatgccactgcactccagcctgggcaacagactgagactctgtctcaaagaaaaaaatatatatatagatttctagatttttatccacggttgcttgtcattgtgcaaattgttgtcattgtgcaaattgtatgatttttaaaattatactaccaaattgtctgtcgctggtatgtaggaagatggttgacttttttttataatctcatttctcctttttttaaagtaagaaatattacaaatatgcagagaagtatagagaataatattatgaacatttatgtatccacctctcaattttgtcaaatcttactacatgaccatgttttctttggatgttgtttgtttgtttgtttgttttaatgacaaattaaacattacacttagagttgaagccccttgtcttcctgatcccatcaccctgccacccttatcagtggtgatcatggtcaccatttggtatttatcatgtgtatttggtatttatctggtaatgtgtcattaccagacacattttcacagttctaccatacgtggctatataagcaaagtaaaatattttgcttatctggaaaatttatttaaatgatatactgtacatatcctgcagcaacttccttttattactcctcataataggtctctggatcttttcatgatgatacaagttgcaccagaccactcatttaaaatgctgtgtaggctgggtgcagtggctcacctgtaattccaacactttgggaggccgaggcaagtagatcacttaagcccaggagttcaagagccagcctgggcaacatggtgaaaccctgtctctatcaaaaaataaaataaaaaagaaataaaatagataaaatgctgtgtatccatgaagtactatacagtcataaaaaagaatgaaatcatgtcctctgcagcaacatggatatggctggaaaccattatccgaagcaaactaatgcagaaacagaaattcaaataacatatgttctcacctatacgtgggggctaaaccttgggtacacatggacataaagatgggaacaataggcactggagaaaccaaaggggttagagagggagggggcaaatgttgaaaaactacctattgggtaccatgctcattacctgggtgatgaattcattcatactggaaaccccagcatcatgcaatatacctttgtaacaaacctatacgtgtacctcctgattcgaaaataaaagttgaaataacgggccaggcaatgtttaaaaacacatgcagccgggcgcggtagctcatgcctgtaatccaagcactttgggaggccgaggcgggtggatcacttgagatcaggagttcgagacaagcctgggcaacatggtgaaaccctatctctattgaaaatataaaaattaaccaggcctggtggtgggcacctgtaatcccagccacttgggaggctgaggcatgagaatcgcttaaacctgggaggcaggtaaaaaaaacaaagttgaaataacaaaaaataaaataaaagtgtctgtaaatatcctgagtatatttattctgttttgtttatttgtttgttttgagatggagtctcactctgttactcaggctggagtgcagttgcacgatcttggctcactatctcagatgatgctccaaagactattcttatacctgtggatgagagtttctctaggtaacatgcagagatggaatttctgtatcttagacagtggatatcaacacttttaagagatgttgctaaattgctcattcttgaatgccaacttccacttccaacaatagttacagagttttggttgctctacaacctcatcagcacttgattttgtaagatactgaatgtaaaattatgcttcactttcaaatttacatttcctctattactagagaaggagaggctcttttgccatttgagcttcctacattatgagtgtgcttgtttgtatcctttgaccatttatctattgtattatttacctttccttatcaatttgtaggcattttttagcactcttagaaacatcttttatgcatgtatttttttttttttttgaaacagagtcttactctgtcgcccggctggagtgcagtggcgtgatctcggctcactacaacctccacctcccaggttcaagtgatttttctgcctcagcctcccgagtagctggggttacaggcatgcaccgccgcacccagctgatttttgtatttttagtagagacagggtttcactatgttgcccaggctggtcttgaacacctgaccaaaggtgatccatccacctcagcctcccaaagtgctgggattacaggtgtgagccaccacgcccagccgaccatttttaaacgtacagttcagagacattaaatatattcacattgtaatacaaccatcagcaccatccatcacctgaacttttttcatcttcccacactgaaactgtacccattagaaaatagctccccttgggaggctaacatggagaaacctcgtctctactaaaaatacaaaataaatactaaaaatacaaaaaaattagccgggcgtggtggtgcgtgcctgtaatcccaggtactcaggaggctgaggcaggagactcgcttgaacccgggaagtggaggttgcagtgagccgagatcgcaccactgcactccagcctgggccacagagagagaccccgtctcaaaaaaaaaaaaaaaagaaaagaaaagaaaagaaaatagttctcctttcttcccaggccctggcaaaccccttctactttctgtctctgtgaatttgactactttcctgtaggctagtggaatcatacagtatttgttctttgtgactagcttttcccctagcataatgccctcaggatccatccatgttgtagcatgtgtcagaatttccatcctttttaaggctgaataatattccattgtatgcatataccacattttattgatccattcatccattgattgacacttgggttgcctgtaccttttggctattatgaataatgctgctatgaacttgagtatacaaatctctcttccagatgctacttttggttcttttgggtatatactcgggagtacaattgctagatcatatgatagttctatttttcattttttaggaagccgccatactgcttgccacagaagctgcactattttacgttcccaccagcagtgataggaacgtaaaagggttacaatttctccacatcttcaccaacacttactattgtctgttttgttgttgttttataatatccatcctaatgggtgtgaggtggtctcttattgtgtgttttgtttgtttgtttgtcttggttttttttggagacatagtcttgctctgtcgcccaggctggagtgcagtagtgcagtctcagctcactgcaaacttctcctccagggttcaagcgattctcctgcttcagcctcccaggtagctgagattacaggcatgtgccatcacacccggataatttttcttttcctttttttttttttttttttttgagacagagtctcactgtgtggcacagactggggtgcagtggcgcgatcttggctcactgcaacctctgcctcccaggttcaagcgattctcctacctcagcctcctgagtagctgggattacagatgcatgccaccatgcccggctaatttttgtatttttagtagagatggggtttcaccatgctggccaggctggtcttgaactcctgacctcgtgatccgcccgccttggcctcccaaagtgctgggattacaggcgtgagccactgtgcctggcccacacccagataatttttatattgtttagtagatttgggattttgccatgttggccaggctggtctcaaactcctgacctcaagtgatccacttgccctggcctcccaaagtgctgggattacaggcatgagccactgtgcccagcctcttattgcagttttgatttgcacttccctaatgattagtgatgttaagtatctttttatgtgcttaatggttatttgtatatcttccttggagaaatgcctattcaagtcctttgccaatttttttgttttcttgagacaggtcttgctctgtcacccaggctagagtgcagcagcaggatcgtggctcaccacagcctcaaactccttgactcaagtggtcctcccacctcggcctcccaagtaagctgggactacaggtgtgcagcatgcctggctaatttttaaatttttctgtagagacaaagtttcactatgttgcccaggctggtcttaaactcctgagctcaagcaatcctcctgcctctgcctcacaaagtggtgagattacagacttgagccactacacctggcctctttgtccatttttaaagtttttggttgttgttattgagttgtaagagttctttatatatttcggacattaaccccttatcagatatatgattggcaaatattttctcccattctgtaagttgctttttcactcagtcaagtgtcctttggtgcacaaatttttctaattttgatgtagtccaatttatctaatttttaaaaatttcctgtgcttttggtgtcatatccaagaaatcatcaccaaatctaatatcatgaagcttttcccttatgttttattccaaaggttttatacttttccgtcaaactcatttttagttaattttcgtatatggtgtaaggaaagagtctgatttcattcttttgcatgtggatatacagtttcccaaacatgaatttggttttgatagtactttgttaattaagacttttgcacctggtagacgctctttgacctctaacccactggaatcctctcaccatccttccctgacagttgaccatttagcttgggcttaatacttccaatgacggaatactcactacttaataaagcagcttttcctgtggtagaacaattgtattttatagaaagatctccattttgagcctcaagtttcctccctgtagcatccacattttggtcctcgttcattctctgaagctgtaggaatcagtgagagctttttttttttttttttttgagacagagttttactctgtcacccaggctggagtgcagtggcacgatctctgctcactgcaacctccaactccagggttcaaatgattctcctgtctcactctcctgagtagctgggactacaggcacatgacaccacatctggcttatttttgtatttttagtagacggggtttcaccatgttggccacgtgaaactggtctcaaactcctggcttcaactgatctgcctgcctcagccccacaagtgctgagattacaggcgtgagccacttcacccagccagtgggcactcttttccaaaggaaagtactttgttgccttttttttgagactgagtctcaatctatcacccaggatggcgtgcagcggcacgatctcagctcattgcaacctctgcctcccaggttcaagtgattcttgtgcctcagcctcccaagtagctgggattacaggtgactgccaccacgcccggctaatttttgtgtttttagtagagacagggtttcaccatgttggtcaggctggtctggaactcctgacctcaagtgatccacccacctcagcctcccaaagtgctgggattacaggcctgagccaccgcacccggcaggaaagtactttgaattgagtaaataacgcaactatatgctgggcagctacctgccaggtttataaggtttaacacatttactccacaaagcaatctatgaaaaggtcctatcattgattcctattttatagatgaagcaaataaggcttgaagagcttatgattttagcaaggtccaacagctatgtaaatggcaccactgatatttcaaaggcaatggccctgaccactctgctacaccacctttctctcctcttctccaatacccagcccaaaactcttttggatctttgattattcttcaaggggcatagctttctttctttctttctttcttttttttttttgagacgaactctcgctctgctgccgggctagagtgcggtggcgagatctcggctcactgcaccctccgcctcccaggttcaagcaattctcctgcctcagcctcccaagtagctgggactacaggtgcgtaccactacgcaaggctaatttttgtatttttagtagagatggagtttcaccatgttggccaacatgatctcgatctcttgacctcgtgatccgcccgccttggcctcccaaagcgccaggattacaggcatgagccatgccgctgcactcggcctaaggggcatagctttctcatcctctgccatcctaggaaaattttaagtattcatattaaaatgaaaactaaacacaattgtccatatatgctccttaggagtagaatgccaaggacctcttagctcctctgacctgggaactacattctctctaatgatacatacgactgggttagaggtttgggcagctgccaccaagtaaaacctctagaattttgctatgtcactttctgctaaggtagcttttcccatctacactaaataaataaatcatccaggtgatttatttttaaccaatgcagaggattttttacttatctccatggagttcaaacatttctccaggctgggtggggtgactcacgtctgtaatcccaacactttgaagactaagaaggggcagattgcttgaacccaagagttccagaccagcctgggcaacatggtgaaatcccatatctacaaaatatagaaaaattagccaggggtggtggtccacacatgtagtcccagctactctggaggctgaggtaggaggatcatctgagcctggagacttggaggctgcagtgagctgtgatggcgccactgcactccagcctgagtgacagagaccctgtctcaaaaaaaacaaacaataattcaccaaatctatttggatctggatcctgccatcattttataggtaatgcctccatagcactcactaagtgccaggcacacttctaagccctttttatacattaacacaaataatccccaccacgacctaatgccatacacatcattatggtcactattttgcaaataagaaaacagtcacagagcagttcagtaacttgtccagggtcacacagctagtccatgactgaaccagaatttaagcccaggatgtcaagttccagaattggtacactcagcctcaatactgtgctgccttcaaatattctgacaatcttagacagctttggggatccaaaagattgagaagtactcttggggacctcttttttttttttttttttaaatacggagtctcaactctctcccccaggctggagtgcagtggtacaatctcagctcactgcaacctccgcctcctgggttcaagtgattctcctgcctcagcctcccaagaggctgggatattacaggcacatgccatcatgcccagctaatttttgcattttaagtagagacaggatatcaccatgttggctagggtggtcttgaactcctgacctcaagtgatctgcccacctcagccccccaaactgctgggattacaggcatgagccaccgcacctggctcccattttttttttaagacggagtttcactcttgttgcccaggctggagtgcaatggagcgatctcggctcactgcaacctccgcctcccaggttcaagcaattctcctgtctcagcctcctgagtagctgggattacaggcacatgccaccacacccggctaatttttgtatttttagtagagatggggtttcctcatattggtcaggctggtctcgaactcctgacctcaggtgatcttcccacctcggcctcccaaattcctgggattacaggtgtgagccatcacgcctggcccctggctccttttttttttttttttttttttttttaaataaagaccaaaggtccagaggctttgaaaggcaaatagtattaagtcaggatttgatatcaggatttctttcattctgtttattttctcattgctttctacttatgatactgtttcatttggtagtaataatatttctttctaaaataaattgaagtaaaaagaagtgagttgatgtaagaaaaatgttacagatatgaaaaaatcataatggtcattaaaaaattagtgaaactttggaaagactgtgttcagtcaagtgaagtgaagttagcttgcaaccacaaaaaaacccctaagtctcaatggtttgaacagcaaagttaattgctcacctatagtacacgcccagcatgggtcggcagggggcgctccgcgttgtggaacgattcatatctatacttgcttccccaacaagggcagcactggcctttaaagcttctgcccaggtgtgacacaggttgtttctgctcacatctcgttacctgaaacaagtaacatggtcacatctcatttcaaaggaagcaagaaaatgtaatccccatcatgtgccggaaaggagagaaatagaatagttgagaacagccctcagagagactataagtaagggggcataaaagatgggtctagagagataggctgagtcatgactcactgaatttgtctgacgtagatcatgatggcccatcccaccaagtggccaacatttgttcccagaaaagggagtgtgatgatcccccagaaagaacacagtctgacaacattattctgatgagcagacacacctctcaggctgccactcaggagtccttttgggtggggaggtggggatgctgatatttcctaagtggtttcagctgaactctgtgatcttttttttttttttttttttttttttttgcctattccctgaagggagatgaggcaatttgggctttggctgagctagggtttggttctgtcaccacttgctatctagggaagggtaataattggaaaggagaggaattcaaggagagggtccaggtgggtagggagcctcacacagggtttggtgatcaggtgattgagaggcctccttgaggagttttcaaagtgcggtctgagggcacctggtatcagaagtgcccagaagctcattaaacacttgggccaggtgctccatggctcctgcctttaatcccagcactttgggaggctgatttgcttgaggctggggttcaagacaagcctggacaacatagcaagacacctccccccgtctctattttttaattaattaatttgtttgtttattaatttatggactctcactctgtcgcccaggctggagtgtagtggcctgatctcttctcactgcaacctccgcctcccaggttcaagcaattctcctgccccagcctcccaagtagctgaaattacaggcatgcaccaccacacccagctagtttttgtacttttagtagagacaaggtttcaccatgttggccaggctggtcttgaattcttagtctccagtgatccacctgccttggcctcccaaagtgttgggattacaggcatgagccaccatgccccacctctatttattaaatattttcttttttttaatctgatgactaggcccactgttggtcctggcacctggaggtaggaccccaggcatctgattttttttgttgttttttttaaggcagggtctcgctctggcgcccaggctggagtgcagtggcacgatcttcactcactggaacctccacctcccaggttcaagcgattctcctgcttcagcctcccgagtagctgggattacaggcatgcaccatcacgcctggctaattttttttttaatagagacagggtttcaccatgttggccaggctggtcttgaactcctgaactcaggtgatccacccacctcccaaagtgctgggattacaggcgtgagccaccgtgcccagccaccatctgatttttttttttttttttttttttttgagacagagttttgctcttgttaaccaggctggagtgcaatggcacgatcccggctcaccacaacctctgcctcatgggtttaagtgattttcctgtctcagcctcccaagtagctgggattacaggcatgtgctaccacgctcggctaattttgtatttttagtagagacgaggtctcaccatgtttggcaggctggtctcgaactcctgaactcaagtggtccacctgcctcagcctcccgaagtgctgggattacaggtgtaagccacctcgcccagctgccatctgaatttttaataatggccccagatgattcttatggacaccaagatttgagaagcattgaatgactgagagaaaatttcttgtaagggtagaagcccagcacagtggttctcagtggagataatttcaacccccaagggacatttataaatgtctggagatagttttgattatcacaccttgagggtagggaaaagtgctgctgacatctagtggctagaggccagacatgctgccagggacaatgtacaggacagtccccacgacaaagaattctctagcccaaatgtcattagtgcttaggtcaagaaaccctggttagccattaagagtttgaacctttctaaatgttggagcacatacgatttttaaatcttcaatttttattttattttccaaaatttctactatatgcatagaatccttttcattgaatacctgttacgcaccgagcacttgaagtttacatcactatcagttcctcttgaaagaccttttcagtcattcatccaacaactatccattaaacacttactaaaatgtattccaggccaggtgtggtggctcatgcctgtaatcccagcactctgggaggccgaggtgggtggatcacctgaggtcaggagtttgagatcagcctggccaacatggcgaaaccccgtctctactaaaaattaaaaaattagctgggtgtggatcccagctactcaggaggctgaggcaggagaattgcttgaacctgggaggcggaggttgcagcaagccgagatcgtgccattgctctccagcctgagtgacaagagcgaaacttcatcttaaaaaaaaaaaaaaaaaaaaaaaaagaagtattccaggcagaggggaaagtatatgcaaaggcccccaagacaggaaagaaaaactttaaaatggctagtatgcctgctgctgataggggtgggggcaagtggaatgaaatgaggttggacacggagggatataaaaacaagggcgtgcatggcctcacagtgttaagtgggagttgtatgagttttgttataaatgcataggaagtcataaaaatttaagtagaagaggatctgagccaatgtacatttgtacaagatcacccttggcccctgagtgaagagtagggggtagggaagccacaggagaaaaagtgaaggggtggggtggaggcaggcggggggggggggaggcggggggggcggtggagcgggggagatcccctccccaaccctggcaggtttaaaaaaaaaaaaagggaagaagtgaaaagacttttgcagacctccagagatgatgcataaggttggctggggtggagatggaaagatggaaaatctagattctgtttggagggtggcaagaactggattttctgatgaactggaaggcatgagaaacacaacacaaagattgtgacttgcaagatgttggcttgaataattgagagaaggtgggtgatgatatatgacatgtagatatgactatcattctcttttgacgactgaggaaggggaggtgagtcgtcctacttcacaaagatagtatatgggctccaggtgtgtctaacccaaaggttataatttttccacactcctatatccacacattaatttttttttttaaattgagacagagtctcactctatcacccaggctggagtgcagtggcgccatcgtggctcactgcagcctccaactcctgggatccagcgatcctcccaccttggccacctaaagctggagttacaggcatgcaccatcacgccctgcctatcttaattttcataatgggtatgacatttactgatagtaatatcattatacatgccccatacatgctaacatctgcttccacatggaagcagcacaaagcctggaaccttcctcaaagaccccccccacccccgtacattggaacaaggtgctgggaacagaagtttagtaggtggtggaagggcagcggctgctaccctgggaactggttttaaaatcttacgttctgattgctgccgtggccatgtgctggtgtgtgatggggagatgttcttttaggtaactaaatccaacgagctgtgattggtgatcgaaccgagcaggcctcctctggatttggagagacatagtgcgtctgggcctgtgattggcgggattgctgtgattggtgaagtccctaaggctatctaagtttctgaacaccagttcctgcgttggccacgaggaggagcccaggaagcgcaaagcgcagcactgcggagagtcttggccgcctcctccgggacgccctccggcccagcgcggtgcctgccctgccctgcgccctggggcaaccgcgggatgaggtggggcggcaaagggtgtcagggctcccagctgcggcccgggtggccacgcttctctgcacagttcctttggcctcttcccctggctcccagccccacagaagacattggctgacccgaggggtggggctgcgggttcgcgaaggtttgtgaaggcccagatccaagttgcaaaactgtggagtctatcaagtgagacttagcagccccactccctcaggtgcgccccttgccctcctcagagtccttctctcaagtttagcagcctccaccgtgccctttaagatcctcaaagaacttttgcaaagtggcatctcattggagctaaaatgacctgtgcaggcaaaggccactagctcaggggatcgtcctgcccatccccaggtgctatcacatcgcgctgtgcgtcttcactgcacttaaccactgtttgtaattgacttcgtttttcatgtatttacttgcttatgtctgcaacccgcctctccaccaaaacgcaagctctgtgagggagggtgtagggttgcccgacacaacacaggacacccagtttcatatgagtgtcagatgaacaccacagtttaaaagtataagcaggtcccatgcattatttgggacacgctcatactaacgaagtatttcttgtgtatcttaaattcacatttgactgggcatcctgtatttttatttgctcatctgcacccctctgagggggatattttgcccatggtcttccctgctgcatctccaccacccacaacgatgcacgcagaaggtgctgaataaatgttgactgtttcgatggacgatttccatcctttattcactcagttattcatccagcctatttatatcaagtgggtcctgggaatacaatggtagatgggacacagtccagtggaggaggcacacaaccagtctaattaccatctgactaaacgatgatgatgtaaagctttgggggctatggggggacagaggaggaccccggcgttctgtttcccggaggaagatgactaagatgggacttggaggatgagaaggcaaagaaggaagtgcgacagctctctgcttgagaccacggggttctggaagctgcagggggctggggagggcaaatgtgcagtgtgggcgtggcagtcaggaaaaggtgagaaggagactcacattcactggatgttactacccaccagccagcacaagagggatgccatgttgctattattgtgcccatcatacagatgaggaagctgaggctcagagaagtgaaatgcctcggctaagtttacagtcgtggagggaaaagctgagcttcaagctcaggtctggcagactctgaagcctgcactcttctagaaaagccactgggttaaggattacaatgccaatagggggatggagaaacacgctcagaaaggtgatagggctctccctgtgaatatggctctgtccagttgagcagaatactgaagcaatgcaagagttatggttttttccaagccctccagagagacaacaggagggccagagcaggacccaggagtccagaccactgtgtctcccattcctattggggttggctctctaggagccccttgcagagccctggggctaattccttgcatggatcctggacaggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccaggtatggtcctgactccacatctgcctggaaggaaggatgggatggtaggagagagacacagaaccaagggggaggattccagactgggagcagtgtggaggatttgtaccctcatcccctaacccaggaacgtccatggccctgatgggtgaatgacgttccaatcagagaaggagaatccagacgacctcaacaaggtgagaggagccccgtagagtattaggggtagtccaaggctgcctaaagaccagatctcttatctctctcattttgcagttggggaaactgaggcacggagagggaaaatgacttgcccaaagccagtgagtcagcaaactgaagcaggtcaagaatccagagggaaccctgaagttccctgagcagaaaacaatcggttaaaatctcattgccacttctgccttgaactccaaatcctccttcctgagctccaggcatggggtcccctccatcccctcacccagagcttgtctcatcggccatgcttccctccctgcctctcatcctcctcctgacttcccctgccacccgcaccacctgaggctggcagagagttcctggcaggttctccagtgctgacgggcacagccaccaggcccccactattccatccaggggacaccttcccactgggtccctatctggatgacttgggacattctttgttctacacttcatcctctctttgggatttctgagtccagacacagtgaggaccccgacagcccccctcctcacctcttgtcctgggaaggccaggcctgcatggcagagatgtaaccagactccaaagctttctgggccgggcttcatggaaggccgtatcggtgcaggggcataaacacaagctctggagccaggtagagatagttctaacaccattgccttggctcactgggaaaatgatgtttcttctctgagcctcagtttcctcacctgtgatgggagacgagaacccttccatcctcaaagcttgctctcagctgctatggaagcatctccaggttgtgatattaaatgaaccaaacaagatacagaacagtgtaagagcagaggctactcatgtatgatcttacatgctatctggtctgtataaagaaaccttggcagatacatctgtaagggatgtggttccccatagtgaggaagtcaaggagaacaggtgaacaggagacagctggaagcaagacttctcaatttacaccttttatgttttgattctgaaccatgcgaatgtagcaccaattcaaaactaaatgtaaagatgttcacaaattaagtaaaatattaaataataataataacacatacctcaataatatgaccggtgtgcagtcaagatttaggcccaggtactagaaattgactcaaagcaacagaggaggcctgtcttcaagtcaccgaatccttgacctagaaaggccctttattttgtcaacgtcaaattgcccataacaacaataatagtcttggtagcaagaatcaggagctccctacttggggaacatggtgccaagcactgtctgaacattatctcatttaattggcattttgattttgtgaggaaacgatcatcattccctctttacagatgggaaaactgagcctcgctgaggttttgactagtaagttgtagtaagtgatagaacttgatgccatcgaaggctttccaggttcaaatttgaagcccccctacagtgggtctcaatattggctgcacaaaaatatagacgcctggcacctccccacccctaccccaagattcgatcattgatctgtgatagggactgggcatctgtctttaattttaaaaaatctttttaaaaaatagacatagggtctcactatgttgcccaggctggtctcaaactcctgggttcaagtaaacctcccatctcagcctcccaaagtgctaggattataggtgtaagccaccatgttcggccaacatctgtatattttaaaggtttcagatgattctatttcatcttcagagatgagtctctgctttgttagacaaaacttctccaatgggaaaccaaggccagggagggaaatgaccttgcccaaggacacacagtggctggaaccagagctggggcaggacacccagcagcttacatgaagccctagggcaaataagaaaaaggcaccccactctgggcaggcagagctccatgggcacttcgcttggcaagtggaacaagggctgggtttccatccctacctgccctcttggctggagaacctttgtgcagtgagcaacctgcacaactgtacagggcagtaactctgatctgagcctcaggacttccaaacacttcaccttagtgacctggcaaatccctggggcccctcagaacaagagtatggggagaccaagggtggcttctgggatgtgggctcagccctcactccccaaaccagagtctgggtcaggcaggggctcccatcagccttcaggccccacaagggccgggaaggccgcatctaattcccaaggtcacccctgcagataaattcaggaacataaacaggagggatgaacataaacaggaggacagcaacaccctcagcccagatgtcataagccacctggcaggaggcagcctgcggagaagctccacccacacagatccaagtcctcctggcttccttcctgatcattctccagaccatactctctgccctacctccggagccttacagtcagcatctcccacagtgccctgctctctgcccttctcctggccatctctcactggcatccctggaagggaagggtagccctggagttagaggcacagactctagagacagactgcccaagttccaattccacttcttgtttctcatcagctgtgtgagcatgggtatatggctcaacctccctgtgcctctggtgtgtaaaaaattggtgaaaacattgcctacctcccagagtggctgggaggatcaaggaagtaacacatgcaaagctcctaaaacagctgcatatccagtggccatgatgatcaatgtgtatattttgcttcatttcattttcatgacaaccctggaagttaagtattataattcccaatttacaggtgaagaaactgaggctcagagaggtggagagagtcagggcagggctctacatctttttttgtgatagggactgggcatctgtctttaattttaaaaaatctttttaaaaaatagacacagggtctcactatgttgcccaggctggtctcaaactcttgggctcaagtaatcctcccatctcagcctcccaaagtgctgatgcctccagagacaggacgtggctgagatggattataacgtagtctccggtttgcagtgcctggctgctggtcatatcctcacagggcccatgggacacagagccaggtgcattcccctgacttgggtcttccaatggctctcaggcacctctctgcttccagccagccctgggaggagggggagaacggcatggcaaggcgtttgcagagccgtcttgttcaccaatgtctttcaagacattgcccgggtccacagagagcccaccattcattcccatgctggctggagcccctgaatacccgaggtgaccttctgtccttggacaagtcacttccccctctgatctccatctccccatctgtgcaatgaggggatggggctgaatcagtggttttccaaccctcaaataaaatattaagactacatgtaaaagggagtcgctggttgaagctgggcctgtggatgcatacccttggctcctgggagcctcggaacccagcttgaaaaaccccagcccacatcctcctaaagattctcctggctctgacactgcagagttctagaaccccaagctcaaagctgccgcttcccatccctgtttggaaagctctcccccagctgcctttatctctctttggtaacagagcaaatttgctcaggacccagcacagggggaacaagcagactgttgactcttgagcaaagcctcttctttggagagcagccgaggtggccgtgggctatgcgttgggaggccagcggcctcttgcataaccctggaggcctcctgcccacccaggccttttcagggttaggggtgaggaaaaccgcaaactcatgcccagttaattttttaaggcaaaatcaacaggctcagcaatgattagcagctgggtaagttggtcttaatcaggctaaggacagggagggaggaaggaggcccagggatggggcccagttatcagttaaccacatgaatgttgcttccttccaaacccactggccttcagccccaagctccctcatcttcctctcggaaatactcctgtgacaagccagtggccacccatcatcgggtgaacaagccagtggccacccatcatcgggtgaacaaacacaatgccactcatggtctgtgatgaagtagaaagtgctcgttgttaagacaaagctcacccaccaccgctgcgtggacttgagcaagtccctttcaccctctgaggctccgtgaggggccccaggtctgggccccaagtctatggttcagtctgtggccagctgccactcccctgacggcctcagtgtttccgtccactaaatgggtgggttagccaaggcatcttttccagtcttgaagctttgtgggtgcctgatttgattaagccacagtggcctttgccgagtgcagagggtggtatgagtggcattttaggagctcaaggaagagaaagggaggggacctacctggtatctgccgttggtatcagcaagtgtcagatcccagctccaggaagagggctgtcctctcagatgggaggcaggggtccagtggggtggctgtggctgcagggacagcctagcagagcctcttggtggcccagaccccctgtccctggaccttggaagccgctaaaggaagcagcaagaccaggccagctggtggctgcctggactggagtttggtcagtggttggggacctatattgtgagatagttaggactttgtccacaaactggaatttgaaatttcaaaggggcaaaactgaagggccctaccccagagtagagatggctcttggcttctttcctccacgacttttgttctttgtcttgataagtcccagttttctctgcacctctcccggagtggtgggtggggaagaaaagataggagataatggtgtggtgagcgccaaggggaagtgaagatgccaagcagccctggggtggccaggcgtgtggaggatgcccctgcccctgcctataccccgggataaggtgctttacttctcaggtccttgagttcccctgcaagactgaggcagtgaaaccaccagctccagtgccttagaattccgaagtcctttcagggattccaggagtcatgatgcaggcaatgcgtagaggggtgaagccctcaagctctggaggcagactcgggttcaaacaacagcccctcccttacgagctgtgtggctttgggcaagtcacttcacctctctgagcctcaatttcatcatctttaaaatggggatgacaatagcccctatctcaacaggcagataatatgagaaggctagaaggtttttagcaccagggctagcacaaaatttctctgtaaacattagaccttattataatgtaaaagagaaacaatgtggttcgtagtggcagctcccttaccaccgtccacagcagaggcacaagctccctacacatgcctccccaactgcaggttgcccagggcaatcccttcccgtctcaactgggtctctctgtgggctctgaggtcctctgctatcccctggaatctgctgcctcttgagctggggcccgacagcaagtgagcagaggtaaagaacagctgctaaattgatggcattgaggctagtgcttgttcatggctgggtgtgtggtacctggagctgtcctgagcaggggtcctgattccaactgattatgtggccagtgtgtcatgcaatcaatgaccaatgacagtgattgctactattgtactgtatgcctacacgtggtcatttaatgcttgaaccatccctacaaagaaggtatcaacccaatttttctgatgcttaaactaaggctgagaaaagtagaagttgaggtcacagagtttggtacattggcactgcctggattttaacctagatctatctgacccacaaggtctgtggtttattcccctaaagagaggtcaggggaagagaggctaagaagcttatctactctctcatttaatcttcacgacaaacgacaagttagaccccttgtacagaaggagtaaccaaggcttcgaaataaaaacttgccttgtgcagacagctggccctgggcttggaatataaatagtcactggtatacaggcaccagagaccaatacccacaggctaacacccactcagtccacagaaagaagcttaatattttttataagcatagaaataaaaaccaaaccaatactgtgacatttgctctgtgacttcctgtatttattatgtgctcatatgaaagcacctaagcattgtcaggataatgttcttcctcactggagggcgttatgaagttgctttcttttttccactagttaaaaaaaaaatcccttggaggaagggaatgaaactttttataattgatacataataattgtacatatatatggagcacatgtattttgatacatgcataccatgcaaagtatttaggatatccatcacctcaaacatttatcatttctttgtgttgggtacatttcagatcttctcttctggctattttgaaatataaagtaaatgattgttaactataatcgctctactgtgctataagaactagatcttattccttctatctcacttatttttgtacccatgaaccaacgtctcttcatcccctgaagaaaacattctttttttttttttagacagagtcttgctctgtcacccaggtgcagtggaacaatctcggctcactgcagcttccacctcccaggttcaagtgattctcctgcctcagcctcccaagtagcctggactgcaggggcatgccaccatgcctagctaatttttgatttttgtatttttagtagagacagggtttctccatgttggccaggctggtcttgaactcctgacctcaggtgatctgcctgcctcggcctcccaagatgctaggattacaggtgtgagcccctgtgcctggcctgaaactttcaaggtctcaagacactgtacatttaaagtaccccaatgttttccttttccacctcccgttctttctccttatctaacatgaagaacattgtattaaatctgatttttaaggagtttttgtctgttatgtgttaagggtttgtttggtaccccaatgaaaacattctgcattgcagaccaaagtgtgcttatttcaggggcatgggatcattgcgttcttagccattgtcacaaaatacatggagtcatatttaaaatgtaaagttgtaacatacatatgtttaaaatggaaatacaaagcaaaaagatggatgtacaatgtcatgtgtattcagttctctgtacttagtaaatgtaacaaactttctgtctattactgaactataggtgcaaggacacgtctccagttactttgcatctgtaatccacaaagattctgggcagctgtattatcatagcttggtttaaataaactatgtagtaacaatgaacaacaagaacaaaagaaataatagcttgcctgaggtcacagagccagcagatcttataggtggtgcgtcatttatatgaggaatgtgtatctaggagatactgtttggcgttggctaagggtggaatgaatcatgtatgtaatagattatgcaatttacagtgatgagtggatagatttacttatggggtaggttataatgtggtgggatgtgaatctagaatgtgcctcctaggcagtcatgcagattgtgcatttggtaagtcaggtatgtcatgattcatgtatctaatagctcttcatttgcagtgtccacctagtagctcttggatataacgggtcatggctgtggcatggtgtggttgatcttggttgatcgtagaccttatttaattgaatctaagatgtcatctatggaaaaatgcattgttatttttgttgccaatgaaattctgacatgacattgatcacattccccgttaagcaatgtggaactgtgcctcagagtggaagaggccatgtattcctggattgtgtggggagtagctgtgcctgtggcctgccataggtgccaggcaggtggcagaggcctgggctcagcccttggaggctcctcccggagctgccctccacatctcttctgtgtttaccccttggtcggatcttctgtttcttcccacctctgcactgcccccaaggccggtggagccaggtcagatactcctgaggtaggcatgggaggaacccgccggtatttggtctctttcagccccttatcaagtctcatagtgtgggttgcagggggctgcctcttgctccctccctcagagtcttgtcctggctaacagaaaactgagccaggatcatctttctattttacagagggagaaattgaagccctgagaagagacgatgtaaataaagttatcggaatagtgactgagctagttcctaaccccaggtctcctgacatcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcattcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcggagaggagaatcatttacccaaggtcccagttagtagacggtaggtgcctgaatgtaaatccaggtctctgcctgctccgggagggggtgggggtgagggaaacaggagaatgtgatgggaaaatccgagatggagccagcctgggccagaaacactgggagctgtgggagacggagaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacgtgatggtgagctcccccttggtgcccagctccagcgattcagcccagcacggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcttgcttatgtatgtaagtgtgtatgtgtgtgtacttgtgtctgtggatgtttgtacatgtgtgctgtgtgtgcgggtcatagagcacatgcgtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccagcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggagtcccaaagacaagaccacctccagctctggaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacgggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtgaactgtggtgtgtgtggtgtgtgtgtgcttgtgtgtggtgtgtgtgcgtgtgtgggaactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaagcgaagttgcccaagtttacaggcgagttagtggcagcatcagcagtagtgcccaggactcctggcacccagcccaagatcctctttccacctgcctctacggcccccctcacatttgtgtagatgcagtagcttttgcctgtgggatgggagggatgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggaagacgcagaccctcagaaacaagtctgtgaagtcacaaccagccccagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgttcttcctgaagcctcactcccttctctcctggcgcagacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacccatccccttgagcccattgttgtttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcaaggttcccaactcagctctaacaccaaccagcagagcgacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcaaaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgtgaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttcttttttttttttttttagatggaatttcgctcttgttgcccaggctggagtgcaatggcagtatctcggctcactgcaacctccacctcctgggtgtgagtgattctcctgcctcagcctcccaagtagctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaccctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgcgggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggcgacatgacttgaacggatccctctgtctctgagaggaacacagactgcaggcgcaaggcagaagcagagcccaggaggaggctgatctaatccaggagagacagcgggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctccctcctttctgaatcagccaagcctcattccacagtgaggcctcttggactccaagggctatcccatccactgtcgggatggtggaaggatcatcttctatctcaggccaggactgacccagatgggagcaggcagtggagcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctccattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcactcgaaggtcaagctatgaggacagcagcctgccctccatcaatgcgctcctgcaggcggaggtcctgtcccgacaggtaccggggtgatcctgccacccacccagggatcccccacactacagaggagctcacctcctccacctccattctccccagccaggccctggagcagctgacgggaggggcctcagatattacagaagggacactgagtccggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcacagagggagcccttctccctcatccctgcctcctccctccctccgtttttaccctgagcttccttcagagctggagggcacccactatccagccccctccccacatctgattccagggagggggctctgtgcaggggacagagagtgcgggagggcccggacatctccagcattttcttccctgtatctctcgaagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccaccttctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttcggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaatggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagttttatgatgcccatttcacagttcaggcaggtagaggcagaggggagcattaagctgacttgcccagcgtcactgagttggctacgggcagccttcccaagggtacagatggcaaacactgttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattagagggctccaggactcagttttcaactgggtaccccactcagatgcaaggaaatgtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacgttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacaatatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactttgggaggcagaggcaggaggatcacttcaggccaggagttcgaggccagcctggccaacataacaagacctcgtctctatagaaactaaaaaaaattagccagggatagtggtgagcacctgcagtcccagctactcgggaagccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcctgggcaacaagagcaaaacttcatctcaaaaaaatacatatatgtgtatatatatataatatatattatatatatataatatatagtgatatatatagtatatagtgatatattacgtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaacttcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccagcaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgaccgcttaagttcctttctaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgatacaagtcaggggacatctgggtcttgactccccagatgctccagctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcattgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttccttttttttttttttttgagacgagatctctctctgccacccaggctggagtgcagtggcgcaatcatagttcactgtagcctcaaccttccaggctcaagagatcctcctaccccagcctttcaagtagctgggactacaggtgcgtgccaccacacccagctaattcttcattcttattttttatagagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggaagaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatcgcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagttggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggtacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattagatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagactatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattatctggtttaattaattctctcattttatagaggaagaaattaagtcaaggtggggcagggtgggaggggagaactttcccgggcctcttcatttactcccacaaaggctggaattttgagcagcccctgtctgtctgtttgtccttccagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctcttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaagtccttggataagtatcttttctttcaggtatcagaaataagactgaatcttctggttctacttgggggttaaaaaattttttttaaaggaagaatgagaatagttttatagttctttgtgatgtgcagaatgtttttgtgtccattataatttttcagtcttcacatcaagaggtaagcagttagacatgattactcccactttccagatgaggagactgaggcttgggggaagtgacttctcttggaaggcagaggtggacatctaaccctggtctcttgattccaagtacttagtatatcgagagagtgaaagttgatcccccttcttgaagaggggagtgatgaggggagagtgcaatggcaagatctggaagaatggcaagagggtccaagggtctgtcatcctccaccaaggttcaagacagaaccttttgctgggtcacctcaatctgccagcaatggaagatgagtagctgtggggacatttcataaaagcaagtggtttttttgttttgttttgttttgttttttgtttttttttctagaacaaggctgtgcacagtggctcacctctgtaatcccagcactttgggaggctgaggcgggaggatcacttgagctcaggagttcgagaccagccagagcaatataaggagaccccatctctacaaaaaatttaaaaattagccaggtatagtggtgtgtgcctatagtaccagctactctgaaggctgaggtgggaagattgcttcagcccaggagttcgaggatgcagtgagctatgaatgcaacactgcactacagcctggatgaaagaacaagactctgtctcaaaacataaataataagtaaaaagaataaaagcaagagatgcacttgagaatctccagccagatctgtagccactgggcttctctccaaggctaaactattacaggagggtggccttgtgtctcggtcaccacagaccacagcgttccattcactcggggttgtgctggagctggcttgtgagaactgactgttagcttctcttcccaactccatgtttgccagtgccacactgatagcttgaaattggttattgccggagtgtttacaccacaaggactagcaaactctacaaatccgggcttttgttcctggagagcccgttgttaacattcaccagcacaccacagcattcggcaatggctggaccatgggatgcctacatatggggacatcctccttggggatgagggtagagcagggcgatcctttcacctcttccttaagggaggggacaaaagttctggtctgggaagcacacgttttgctgatcagcgtaaccttgggcaggtcactccaccactccgagcctcatctgtaaagtgggaatgatatctccctccagggcagatgtcaggattcaatggaatgagatcacagtaactgtgagagctcccgttacatgaggagtacaagtgaactcttcatgcgcccctttttagcgagaagttaaccattaaactctccaggcttcagagcacccattcgctgtctacctgatccctagggccgctcccgccttcccctgtgccttccctccactagtcagcaccaggaaatgttttcgataacgttgcaacggaggccttgttcatgctgccgccatcggggacaagcgcgggggggggggggtggaggccagaggagactatttcagtcctaaattgtgcttaataaacccatatcaaaaccataaacccttggctgccataaattcctctacccttggatcctccacctcatcagccctttgccctggttaatctcaaatctcagcgcaggcagccggagctttaggtttggtttctacttcagttgctaaacagcatcagctcaggtggcagacagtaaaattcccattttagagatgatgaaactgaggttcagaaaggtgaagaaacttgtccaaggtcacacagctagagaccccagccaagacctgagcccatgcttccaccacccaggtagcctgattaagaaatgggaattcttggctgagcacagtggttcacccctgtaatcccagcactttgggaggccaaggtgggcggatcacctgagattaggagttcaagactagcctggccaacatggtgaaaccccatctctactaaaaatacaaaaattagccgggcacagtggtgcacacctgtaatcccagctactcaggaggctgagccaggagagttgcttgaacccaggaggcggaggctgcagtgagccgagatcatgccactgcactccagcctgggtgacagagcgagactccatctccaaaaaaaaaaaaaaaaaaaaaaaggaattctcaattctcaagcttctcggggagacagatttgaggtttcctcttacatctttgtttggtggccctacaattaaacctctttctctgctacaaaacaatggaaaaaaactggaatttctaaggctcctcattttttttttttttttttgagtcagggtctcactctgtcacccaggctggagtgtagtggtgccatcatagctctctgcaacctctgcctccagagttcaagcaatcctcctgcctcagccttttgagtagctggggtacagtgtgccagcacacctggctatttttttcttttatttttagtaaagatgaggtcttgctatgttgcccaggctgacttctttttagcacctctgaaaagttgtttccccaagccatgctactagaagcttcttattccatcattccatcattgctcagagtggggaccagaagtagaagggaccctgggtgacaggctgcttgaagatccaaagaaagtttcatgcagtgtgaatggcctgtcatcccaaattggtgaaatcgtcctacttcctcatttgtggaacccagataacctttgagctacacttctcaaatccacgtatcatatgtaaattccaggatgtgatctcagaggcctgaatcacaggatcccaggcagctgtttgacaatggtggagttagacaccaaatcatgatgccaaggacatttactgggctcttcctctttgccaaacatggctggacataatttaattcccacaacaacctctgaggctgtcattcttgtggttctgtttcacaaatgaggaaacaagaccggtcatggtggatcacgcctgtaatctcagcactttgggaggctgaggcaggtggatcacctgaggtcaagagtttgagaccagcctggccaacgtggtgaaacctcatctccattaaaaatacaacaaaaaaaaaaaaccagccaggcgtggtggcatgtgccagtagtcccgactactcgggaggctgaggcagcagaatcgcttgaacccgggagacagaggttccagtgagccgagatcatgccactgcactccagcgtgggcaaaagcttgagaccctgccacaacaacaacaacaacaaagaggaaacaggctcaggaggagagaggaagggacttgcccaaggtccacacacagctggtcaccaatccatacctggtgtggccgctgatctgatgctcattgtctgactccaggggccaatatgaggcctcgaggaagacactggtgactccatcactgcgtggtgggcacagaagtagtgtgaatggtggaaagctcatctcatgacaaatgttgatgggcagagccctgtgccgggaaccctgggattatggagaagcaatagcgtgaggcgcctccctcccagagctttcagttttcatatggacaggcgaaaattagaagcagttaagagccaaaggggtgaacgtgacagctggtgaggtggtagggagggagaggcgactgcactcagggagtggtgtatgctttgagggacgattcagaggcaataatgaggcaagacagaagtgcgctcgaggctgaggactgagcagcaagtgggaggaggcagcgggaactctgtgcatgggggcaagacgagggctggcattttccaaccttcgtgcacaggccaccttgacctctccatgcccaaggaccgctgtaacttccattacttatttttcattaaatcagttcaacatgattccccttaaacttcaggtcactgacataaataggaaaccagcatcatttgccgtaaataagaggtgactgcaaaattagtgaaaagaaaacaatgtttttcagctgcagccaggtggaatcgccccagggaaagctctgctcttgttttcgtattaaaaaggaaaactgacaaatattacagagatgttacgggcatacacgtacccaatggagactttctccttaaagctttcagaaaaggcctgtaaaggacagactttggggacaatatcacttaataccttccagtatgtttctaaaacttcccccagttccactggaagccctcatccacttctggaagctcactcactaggacagctggcccgcacacaagtggtggggacctcaaatactggacagaggagtatggaatttcttccggggaaaaggaagccactagaggtttctgtttgttttttgagaggggttctcgctctgtcacccaggctggagtgcaatggcgcgatcttggctcgctgcaatctctatctcccaggttctagcaagtctcctgcctcagcctcccaagtagctgagattacaggagcatgcaaccacacccagataatttttgtatttttagtagagatggggtttcgccatgttggccaggctggtttccaacccctgacctcaagtgatccacccgccttggcctcccaatatgctaggattacaggcatgagccgccacgcccggcccactggaggtttgagagcagtgaaggttgtaggcagatctgtatatatgtatataaagatacatatatttatatatattatatattatatatttatatattttatattatatatttttatattatatatattttatattatatattttatatatatttttatatatctatatattatatattttatatatatttttatatatttatatattatatattttatgtatattttatatatttatatattatatatttatatatatttatatattatatatttgtatattatatatttgatatattatatatgtttatatattatatgtttatatattatatatgtttatatattatatgtttatatattatatatgtttatatattatatgtttatatattatatatttatatattatatgtttatatattatatatttatatattatatgtttatatattatatatttatatattatatgtttatatattatatatttatatattatatgtttatatattatatatttatatattatatgtttatatattatatatttatatattatgtttatatattatatatttatatattatatatgtttatatattatatatttatatattatatatgtttatatattatatatttatatattatatatgtttatatattatatatttatatatgtttatgtattatatatattatatatgtatgtatgtttacatacatatatacatatgtgcgtatgtaaacatacttatatacatatgtgtgtatgtatgtttatatacttatacatatgtatatatatatatttatacatatatgtgtgtgtgtatatatatatatttttttttttttgagacagggtctccctctgtcacccaggctggagtgcagtggcgcaatcacagcccactgcaacctctgccccctgggctcaagtgatcctcctacctcagcttcctgaatagctgggaccacaggcaccaacaactatttttttgtatttttagtagagacggggtcttgccatgctgtccaggcttgtcttgaactcctgagctcaagcagtccacccgcctcggcctcacaaagtgttggaattacaggtgtgagccactgcacctggccagatctgtatctttaaaacaacaccctggctgctttgtggcagacgaagaggtgcaactgtaagctgggagaccaatgaagacacaagtgcactggatcaggtgagaggtagtgatgtctacaacaagatggtggcagtggagtagagaaaagcaccaatccaagagactttcattcattcattcattcattcgttcattcaacaaatatttagtgagtgtctatctgttgaacatttttctgagtctgagaggtaggcaggggtgagaccagaggtagccttctaggccacgagaaagattctggattttcttgttggtatagtaggaagctcttcatttttgaatagagaagtgatatgatctgcttgatgttcttaaaaggccactctctgctgtatagataatggactatgtggaaaaacagtggaagcagagacgcccacaggtggcctgggcagtggtccaggtgaaagatgatggcagcatggactagggttgtggagtgggcagaattttttaaatgccccccaagacgcctgcctttggtgcatacacaccttctttcagttatccaattagacatgaatctaggtgttcctgtgaagagattttgcagatgtaatttaagtcccaaaccagctgactttttgatagagagatattctttggtgggcctggcctaatcaggtgaggccataaagggagctgaactctttctatgaaattagaaacatgagaattagaaacgtgagaaattagaaatgtgattccacataagggagagtctctgttgctggctttgaagacaagggggccacttggcaagggatgcaagtggcctctagaaactgagagacccctggctgacaaccagcaagaaaatggtgacagggtgacagtccaacgaccatgaggaactgaatgcaggcaacaacatgaatgagcttggatcctttcctagagccctcaggtaggtacacagcccagtcgtttaagaacccgagcaggagacccaatcacaccacatctggactgctggactatagacctgtgagatcacaaatgggcagcgttttcttttcttttctttggaaacagagtttcgctctttttgcccaggctggagtgcaatgatgtgatcttggttcactgcaacctccacctcccaggttcaagtgattctcctgcctcagcctcccaagtagctgggattacaggcatgcaccaccacgcccagctaattttgtatttttaatggagatggggtttcaccgtgttggccaggctggtctcgaactcttgacctcaggtaatctgcccacctcggactcccaaagtgctgggattacaggcgtgagccactgtgcccagctgacaaatgggcagtgttttaagcatctgcatttgtggcaatttgttatgcagcaatagaaaatgaatacaggtggtggtggtgagaggcggtcagagtggagtgttctggaagtagaacagccaagaacttactaaggtatgtgaaggaaagtaactgtggccaggtggtgctgtctgttgacagaggaagactggaggagctgcaaatttgggttagaaaataagagcttggttttggatgtgctgtttgagatcccaattaaacatccagggacttgttggatatatgagtctagagcttggggaaaagttggggctagagataaagagtctaagtcataagcatagatgagaagtttaataatcaactgggctgagcatggtgctcactcctgtaatcccagagctttgggaggcgaaaaagggagaatcccttgaggccaggagttcgagaccagcatcggcaacacagcaaaacccccgtctctacaaaaaattaaaaaaaaaaaaaaaggtaggtgtgctggcacatgcctgtagtcccagctcctctggaggctgaggcaggagaattgtttaagcccaaaagtttgaggttgcagtgagccatgatcaaaccactgcactttagcctagatgatagagcaagaccctgtctctattgaagaaaaaaaagtcaataggaagattgctcagcaataaaaagaagagaactactgatacaaacaacatgggcccagtcgtggtggctctattcctagcacttcgggaggcggaggagggggtggatcatttgaggtcaagaggtcaagaccagcctggccaacatggtgaaaccccatctctattaaaaacacaaaaataagctgggtgtggtggcacatgcctgtaatcccagctactcaggaggctgaagcagaagaattgcttgaaccctggaggcggaggttgcagtgagctaagatcgagccaccgcactccaggctaggcgacagagggagacttagtctcaaaaaagaaaaaaaagaaaaccatggaactcaaactcataacactaggtgaaagaagccaggctcagaagactacatactatatgattccatctctgtgatgttctggagaaggcaaaaccatagacacaggtatgtggctgccaggggcaagggctggggtaggggtttgaataccaagggacacaggggagggggtttggagtgatgggaatgctctgagaaaatcttgattgtgatggtggtgacatgactgcatacatgtgccaaaacgtgcaaaagcatacactaaaaagggcaaatcttagtctatggaaattataccttaatttggccaggtgcggtggcacacgcctgtaatcctagcactttgggaggccaaggcaggcggatcacctgaggtcaggagtttgagaccagcctagccaatatggcaaaagcccatctctactaaaaatacaaaaattagctgggcatggtggcgcacacctgtaatcccagctattcgggaagctgaggaaggagaatcgcttgaacccgggaggtggagaggttgcagtaagccgagatggcaccactacacttcagcctgtgcaacaggagtgagactccatctcaaaaaaaaaaagaaagaaaattataccttaatttaacaaatgaaagaaatgaaaagccaatagttgcttgggctcattgaagagtgaagagaggaaacagaaaataggtgaggacttcactctaggttgcaccaccatggaggttggagagagggaaagggaaagctgcaaagaacaagtgaggtgaatagaggccgggcatggtggctcacgcccgtaatcccagcactttggaaggctgaggtgggaggattgcttggagcaatcctcaggtccctaggagttcaagacccaccagggcaacttagtgagaccccccgatctctgcaaatataaaaaaacttaaccaggcgtggtggtgtgtgcctgtagccccagctacttgggaggctgaggcaggaagattgcttgaatccaggagttcgaggctgcagtgaccgtgaccgtaattgtgtcactgcactccagcctgggaaacagagtgagaccctgttgtaaaaaataaaaacaaaaaagatgaatatagttggtgaacgaaagggattcaagcaaatttgttgcagacctactaggtgctaagtgtgctgacatactggtcttacccactcaccttactgagattgttggggaggtgaaatggactagccctgctatacggatgagaggaaagtggtttgccctgggtccacacacagcataatagtggtgaagtgagaatatccatgctggtgtgtcctgcacactcttccctttgtatcaaatgagtggaagaatgaatgagtgaatatcactgcaggtgctgaggtttcactagcagattccagccaaggatctgagaacgtgatatttttagcgaagttggggccataaaacttgttccatttcccaacttgtgcaacgcccagcccctccccctgtggctctgagattgctccccggccttgggaagggctccccaggcttatctaggggggagagtgaaactgtaaaagcctttatggctttgagatcacgtctgcaaggggcagcgattgtcgttataaacttgagctggccctgcaagggagggcaatagcctgggctgagaggagtcaggggagagttgagcaatgccaagggagcggccgtgctgagccgagcattctggggcctgtggtcagggaccatcattcatttacctcatttcatcctcacataaaaccctgtgagtttttttctttttgagacagatcttgctttgtcacccaggttggggtgcagtggctcaatcatggcccatggcaacctcgatcccctgggctcaagtgatcctcctgcctcaccctcctaagtagctgagacaacagacacatgccaccatgcttggcaaatttttaaattttttggagacttagggtctcactatgttgcccaggctgatctcaaactcctgggttcaacttgtccccccacttcagcttgcaaagtgctgggactgcaggtgtgagccactgcgtctagccttattgcaatgtttttaaacattctatgacatgccctttttcacattatggtatctctgaaatcaggatgcgtctttaaatcaatggcgtcccacaattgctaagggtttgatcaggtggtagccctgacctagttggttctggtcattatttccagtggcctaactggacaactgcaccccctttgtatttcatcaaaaatgacttaaggaccatttgaggaagggaccagagtcctgcttgtttcccaaaaccttccattaacaccttctgataagatcaagaaagcacctggggcaaaacctgcagaataggaggaagtgggttgggaggaaatccaggagacaatagtggagtgttttttcaagaaatgctgcatgggccgggtatggtggctcacgcctgtaatcccagtactttgggaggccaaggcgggtggatcacgaggtcaggagattgagaccatcctggctaacacggtgaaacctcatctctactaaaaatacaaaaaattatccgagcatggtggcaggcgcctgtagtcccagctactcgggaggctgaggcaggagaatggtgtgaaccccggaggcagagcttgcagtgagccgagatcccaccactgcactccagcctgggaaacagagtgagactccgtctcaaaaaaaaaaaaagaaaaaaaaaaaagaagaaatgctgtaggaacaaagcattaatgggatggaagttgatattgcatggaaaaatatggacaatgaagattctgggcagaaaagtgacctcagtgggctggatgctgactgtgagattttgaaactccttacctaatctatcttacccagattttcctttttatgtgtgcacaagggtgatatatgattttttattttcttgagacagaatcttgccctgtcgcccaggctggagtgtaatagtgtgatctcagctcactgcaacctccaccttcccggttcaagcaattcttctgcctcagcctcccgagtagctggaactacaagcgcgcaccaccacacctggctaatttttgtatttttaatgaagatggggtttcaccatgttgaccaggctggtctcgaactcttgacctgaagtgatctgcccacctcggcctcccaaagtgctggaattacaggtatgagccaccatgcctggcaattttttttttttagatggagttccactctgtcgcccaggctggagtgcagtggcaagatcttggctcactgcagcctccacctcccaggttccagcgattctcctgcctcagcctcccgagtagctgggataaaaggtgcccgccaccacacccggctaagttttgtattttcagtagagatgggttttcaccatgttggccaggctggtctcaaactcctgacctcctcccgcctcggtctccaaaagtgctgggagttttacaggtgtaagctgcagtgccctgccaatatataattttaaaaactatgtctaagtctcaaagagccttttaataaatagaaaataaaaattctaagtgataaggaggcattgtcacaattaattggcagtgtcttttctaagtggtacataaaatgctagtgctgcttacagcagaagcatctccagtcaggttatctcatttcacagatgagaaaactgaggacacagaggccacagggcaaatcagtgatggtgccagggctctctctgacaacagatactgtgctcttcctgacacctgaggatgacttggatgtggattagccccctggctcttcctccctcaaaggtcttggtcccagccagacaactccaactctgccatcccaagggcctctgggaggcagtaagttctcctattgttcaaaactcaggccagcatggtggctcacacctgtaatcccagcattctgggaggccgaggtgagcaaatcacctgaggtcaggagttcaagaccagcctggccaacatgatgataccctgtctctactaaaaatgtaaaaattacccaggcatggggtggtgggcacctgtaatcccagctactccggaggctaaggcaggaggatcacttgaaccggaggctaaggcagaggttgcagtgagccaagatcacgccactgcactacagcctgggagacagagcaagactccatctcaagaaaaaaaaaccaaaaaactctagctgaggagggttagccggaagccttcttcccaatgtaccaaccacccctacttcccactgctcacctcagcaaccccagtctggccaagtccatcccaacccatgctgccacacgcccttcatgctcttcctaggacatttaatcacctggtcttgggccaggcagactggactctcccttcattttacagacaaggaaactgagacacagagaggctgctggactgttgcaggcaagtcagggaagggcacggtctggaacccagggctcaaaatgcagtgttctttccaacttcacagatttcttagatccagaagaggcaggctggcaagggacagcaagggactcagagtgagtcaaaagaaaggacttccagatcagaaggattggtaagacctgaacatgtaattgtgggatgatgccaaaggtcttcacctgactcttgtcaacactaacaggttccgggacagctgcactctagggggccagtagaggcaccatcttgctcaaagaatggggccaaactacaccaggcatctctaccatccccatcagatcctacctctctctgcttaaaaccctccaatggcttcccatcattcttggaacaattttaaattcttcaccagggccccaaggtcctacagaacctggttcctgatcacgcctatgagatcatctccccatggtcactccattccagcccccttgggctcctccctgttcctcaacacactaaagctgttcccatttcacagcctttaccctaatgttccctttatctggaacattctgtcctcagctcttctcatggccacttccttctaaacattcaggtccctactcaaacgttgcctcttggagaggccttccctgatcacttggctaaatacacgaggctttgcaggatatacagtccctgctgcaactacttaagtctgctcttacagcgtaaaacagccataagcaatatgtaagtgaatgggtgtggctgagttcaatgaactttatttacaaaagtaggcagtaggctggatttggcctatgaatgtagtttgcttactccagctctaactaattgtcttgtttgattgtcttcctctatccttccctctctagactgttaactccataagagcagagactctagtctcattcaatgctgctgtggtagccagcctccaagatgtcccccagtgatccccatttcctggtattcccaccattatttactcccctcccaaactgagtagcgttgtctgtgtaatcactaggatattgtgaaaaagatggagtgtgacttttgaggctagatgataagaggcattgtggatttcatcttgccaccttgaatcccttgctctggggatgccagcagccatgctgtaaggacactcaagcaatcctatggcaaggtccacatgggaggaattgaggcctcctgccaactgccagccatgcaagtgagccaaattgaaagtggattctcaagccccagtcaagctttcaggggatcactgtcccagctggtattttgactacaacctcatgagagatctaagccagaaccatccagccaagccatttctgaagtcctaccacacagaaactatgatataatacatgtttgttgttttaaaattaaggtaattagtaattagttatgcagacatagatgactcacatagttgcctagcacagtgtctggtcacagaataaataggctaattaatattggttaataaataagtgcttaataaatatagaaggacacattataaaaataaatgtttggggccgctgcggtgagtgcattctcactcaataggcgccaactaaacttttattaaaataaaataaatgtttgaaagacaaatgtattatagtttttatataaataaatgtaaaaatatacattaaataatatagaagggcacaattaaaattttcctaatccactgatagtccttggacaagatgcctatataagaattctttcaaccttgagatcctaagattcggagattctcagtttctgtgtataattaatgctaagtctaggattatataattctgagactttaggcttctgtttcaccaagtccatggctctaaaagcttgtgattctaacatcttatgattcatttatcaacatatatcttggctgaacaactcttctctgccaggcacagtgctgggtgctagggattcagtagagaaaagatgatcccgatatctgccctcctgtggctcatgagtggatggggacacaggcaaacacacgggcacacatgatgtagtgatctctgtcacatggtaagcacagcagctggggtggggactgtggtaaatgaaggaacaccaacccagatattcaggagggatgtgagcagaaactgtcctcagagcaaacaggaagagagaggacttcaaccagagaaggaggtggtgttgtagactgtgttccaggtagcgggaacagccagtgcaaaggtccaggggtcaggggagagagccagcatccagcacatctggtgaagcaaaacaagttctgtatgggttggtatagagttgggggtggggggcggtagaaggcagagtggccagactgtggccagatgactgagaacctagtaaaccatgtcaaggagtttgaactttatcctgagggcaaaggggagccagggaagggttttaaggggcagcagagtggcacaatctgcttggtagtttggaaagatgcctctggctcctgtgtacgggtttggaaggaggagagacaagagacaagtctggaacaagatcccaggtgagagaagaggcctgagtgaatgggaggtgggccccagagagacatttcatttacagtgtggggaatggacagggagttggtggcagtgtgggttatactggtaacctaggagcccaggactcctagattttatgattctaaaattcttggccaggcacagtggctcatgcctgtaatcccagtactttgcgaggccaaggtgggcagatcacttgaggtcaggagtttgagaccagcctggccaacattgtgaaaccccgtctccaccaaaaacacaaaacaattagccgggcctggtagtacatgcctgtgatccctgcgactcgggaggctgaggcaggaggatcccttgaacccaggaggtggaagttgccctgagccgagatcgcgccactgcactccagcctggttgacagattgagactccttctcaaaaaataaaataaagtaaaattctctgattctgtgttcaacactccatcattcttcaacacaaaatgttcaatgatatcaccatatgtgtaggatgcccaaccttaccgccctccatccctcctttctgagcttcagttttccttgtttacaaagtgaggatcattaacactgtccttgcaaagcagccgtgggagtgggagacggtgtgtactcagcatctgcacagaaatgtggtccatcatggcaggcgtgtttgtctggaagtgctcaacacacaggcactgtcaggaaagagccgggtgttgagagaacaagacatcagcagggaagagcagggcaggcaaggaagagcctggtccttgtctgctcctggagacctgggctgctctggcctcccggcttctgcctgggcatctgatacccagatttggttgtttgcttccgggtaccgacaagtttacatgttgtttgtggaattccccatttctgcagctggccagaaactcccctttcctggtcttaaactcccccaagggctacagacaccagctgggggtagccaggcaagatctggtcttccctggactgatctaagccagatcaagtcccaacctgctcacactctagcgccccctctaggtcacactataggcattcccttcttagacaactaactgtccattggctccagcaagagcaagtctttggagacagaaccctcactcctctccccaaaacacatggtctcctgaaccacacccaaggtttatgtgtctcctgcattctaatttgcttctcaccaatggttcagttttaattcagtccaatccacaaaacatccattgaagccgggcatggtggctcacacctgtaatcccagcactttgggaggccgagacaggtggatcacttgaggccaggagtttaagaccagcctggccaacatggtcaaaccccatctctactaaaaacacaaaaattagcagggcgtagtggcgggtgcctgtaatcccagctattcgggaggctgcagtgggagaatcgcttgaacccgggagacagaggttgcagtgagctgagatagctacactgcactccagcctgggtgacagaacaagactccacctcaaaaaataaaataaaataaaataaaataaattgaacaacataactgtgacaggcttacccgttgcttggagaaagagatgggaggccagcagtggtgggcctgaagctgccagtgcttagtggatcagggttgggcttagggtgtgaggccagagagctcagttcatttctttgcacacagtaggggctctgtaaacacccgtgaaattaaatcaaattaggagtttaagtgacacaagctagcatgtgcaccaactatttccggaaggcgatgagagaccggagagtgagatggctttcggggtgggtgttggggggctgggtagctggggtcggggtgggaggaagacctacttctcattttatgcccttttgtaccttttgaaatgttttactttcaccacatgcacacagagcagaatcaatcaaacaaacaatcacaattaaataaacaatgcagggagccaggctgtctcagagctccatggcttcatgcctgctcttcctgctggtgagatactgtttcccagctttctccaactggggaagtacacgtcctccaagaagtacacaaatgtcctgtcttctggggcctgttcctgcctccctgtgatggttcttctctgcttacccacctcatccacacacgagtggtccaatctccaaccctgtctgtcctgctctgtggcctggaggcacctgtgccttctgacatcacaatacattcagccaaggggaggaatcggcagagataaaagggcaggatgagggagaactgggcatgtttatgccacccccagctccctccctgttttgccttaattttggcagtggctgaatttctccatggtcttaactcctgtcttagcctcacttatatggctccagctatctctgggtcaagtaacaccattctctctctcacctctttggccttggggtgctaacagctccccactgttgccagtccctgcatgcctcacctctgcaaacacttccttcattaagtttgcttcagttaagccagtggttcacaatctggggtgactttgcccccaggggacattcggtgatgtctggagacactttaggttgtcatgactggtagagaagatgctactggcagaggcaacagatagtgctaaccatcctactccgcacaggacatcccccacaacagaattagccagccccaaatatcaatagcacggagactttgggtctcccactgctccctgcctgaagcccgacagttcatggctgggattctggactcctgctggcctctctgctttgtggtgtgatctgccagtttccacacctgctgttgatctcctcttagtgacacagagatgaaaagaccccatccttgccctcaagctggccatagtgcagtggagagagaccctggtgagcggggttccccagcagcctcgagtccttgagggcaaagtctctttgtcagtcaccacgtagccccagtagtaggagagcagcagacatttgccaattgaaacaaaaggtcctttaaaaatatcttaaaacaaggccaggctcagtggctcacgcctgtaatcccagcattttgggaggccaaggtgggtggatcacctgaggtcaggagtttgaaaccagactggccaacatggtgaaaccctgtctctactaaaaataccaaaaaaaaaaaaaattatctgggcatggtggtgagcgcctgtaatcccaagccactactcgggaggctgaggcagggagaactgcttgaatctgggaggtggaggttgcagtgggctgagattgcgccactgcactccaacctgggtgacagagcaagactctgtcccccccaccccccccaaaaaaaagtcttaaaacagacagaaggttaggctcaatggctaaacaagacccaggaaaccctggtgagtttccctgtaacaaaagttccaaggaaaccacaatcaggcaaagatgtaccaaatgaatgaattctagtcccaggggtatgggtgggtgagtgggacagaagacaactatgagcatcccgtctctaaaatggttataatggtagaacccacctcctaagattgaatgagattaaatttaatgaaaatcacttacagtgttacctagggcatagtgagcaccagataaacagtatccaccagctacctggaggaaatgatggggcagcagcttcaagacgggtctagggaagagctctgccgctaatattggactggtttgcacccctgggcctcactttcccaatctgtaacgtgaggaaaatataagcaagattagtgttttgcagaaattatatcatagggatgcttgagaggggttctacaatacgtagtgcaaatatcattttcaacatcaaacctgtaatttaatacaagtaaaaggtcagtctgttaaactggagggaaatattaccatcaggcagggctagggtgaccaactcatcctcttttgcccaggacttgtctagttttagctctgaaagtcctgtgtcctgaaactctccctcagtctcagcggattaggatggctggtgaccccagcaggtcaaatgatcagcttgcccatactaattttaaagataataaatagctagctgcccgacacagtggctcacgcctgtaatcccagcacttagggaggctggctcgggcaaatcacttgaggtcaggagtatgagaccagcctggccaacatggcgaaaccccgtctctactaaaaacacaaaaattagctgggagtggtggcagatgcctgtaattctacctacttgggaggctgaggcaggagaatcgcttcaacccagcgggcagaggttgcagtgagccaagatcgtgccactgcactccagcctgggcaacagagcgagactccatctcaaaataaataaataaataaacaaacaatatatgttgaatacttattttgtgccaggcactgacttcacaagtattagctcatttaatctttataagaacccagcaaggtaaatattaacatctctctttatacaatcgcacagaaaggttctgtaattgcctgagttcacacaactcctgagtagtaaagccaggatttgattccaggccatctgggtccagagttgccatatttaatttgacctgtgctatatatttgaatatatttttattttttattttttgagaggaagtctcggctctgtcacccaggctggagtgccgtgacatgatcttagctcactgcaacctctacctcccggcctcaagtgattctttagcctcagcctcctcccaagtagctgagattacaagcatgcaccgctatgcgcagctaatttttgtatttttagtagagatggagtttcaccattttggccaggctggtttcaaactcctgacttcaagagatctgcccacctcggcctcccaaagtgctgggattacaggcgtgagccaccacgccaggcaaatatatttttaaaacgtctttggagacagtaataatatcaataatgatgataataataataatggaaatatattttaaaacatttttgaaatagtaataatgacaatacatttttgaacactgaaatatgcatcccaaaatttaacactatggaggccacgtataaactaacttgagctgcttgattagcccattgttgtgcagaccttagaataaagcatttttggccacctctgctgaattaaagctagaatggaagactcaaatgtttacagggccaggtgggtgatgtcagtgagtggttttagggcaacagagagtggtggggactgtggcaaacgggaatagaatgcatgagctgagaagatgcagccaggactcaactccaggcacttggaattggggaccagcaatggcagatccttcaggaggagacaaacatccatctttatcagcaactaattcaatgaaaacaatacaaaaacacaaggtgtgtgaaacaaaacgtgcctgtgggtcaaacccagttcctgctctccttccaccgctgccctgcccaaattgaatgtgtgctcagattatcaggaaagctgttaaaaacaacaaccacaacaacactggccaggtgtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaaccagggaggcggagcttgcagtgagccgagatcccgccactgcactccagcctgggcgacagagcaagactccgtctcaaaaaaaaaaataaaataaaataaaacaaaaaactatttgaaactgtggcatattcattcaatggaacactatacagtaacaagaataaactctagctatgaaaaatatggatgaatctcacaaacataagccagacacaaaagactacatcctgtgttattccgtttctttaatgtttaacaacagacaagactcatctctggtgtcaggagtcaggcttgtggttaccctggagaggggtgctagtgagtgattgggaggggcaaagggaagacttctgggagcctggccgggttccatttcttcatctgggtcccagtggcatgggggttctctttgcgatgattcattgagctgcacacttgagtttgtgcattttttgatgtctgttttttggtttttgttttcttttgagttgaaatatttgtcacccaggctggagtgcagtggcacccaggtggagtacagctcgctgcagcctccaccttctgaggctcaggcaatcctcccacctcagcctcccgagtagctgggactacatacaggcacgtgccaccatgcctggctaatttattattattatttgtagaggcagggggttttgctatgttgcccaagctagcctccaactcctgggctctagtgatcctcccgactcagcatcccaaagtgttaggattacaggcattagccatcatgccaagccgtatgtgcgttatacttcaaaatttatgtaaaattttttgaaacacatacacagaaaccattaccatttggaaatatttctctggacaaagcaggattgtgtttggatagaagggaaaacaaatgaggaaataatccattccaagtatgggaagcatctgacgaccctttgctgaatagggtgaaaagaatacaattgtcagggctgggctcaccactgaactccagcctggacaacagagccagaccctgtttcaaaaaaacaaaaaacaaaatgaaaaaacaaaagtgtctccttggagaggcctttctaggaagcaaccttcccagttacttcctcttagggtactataacttccccttaggaaatgctgattacagtctgcaattcccttgtttatttggggttttctttcttttttccttttttattttttttgagatggaatctcgctctgtcacccaggctggagtgcatggcaagatctcggctcaatgcaacctctgcctcctgggttcaagctattctcctgcctcagcctcccaagtagctggcattatgagcacccaccaccatgcctgtctatttttttgtatttttagtagagacgggatttcaccatgttggccaggctggtcttgaactcctgacctcgggtgatctgcctgcctcggcctcccaaaatgctgggattatggacgtgagacactgtgcccggccctttttttctttttttagtttattgtctatctccccttcatgaagacaatgattttgcctgtcttatccatcacctggcacatagcaggtgtcacaaaatatttattaaatgagtgaagagaagaagggagggagagaaggaagaacaactgagtggataattgggagttaacaaggcaaagctgggggcagttggaagctgtgaagaccgatgcgactagagatgagagaccagggggtgcggcaggcaagatgatgtccattttacagatgaggcatctgaggctcagagatggcaaggggcatgaccaagtcatccagtgggacaggtcctggatgaatccagtttccgactcaagagtcaatagaacctcagttactgagcactcatctgtactaactgatgaggtgagtattgttattccttcctaaggcacagccaggaacagtggttcatgcctattaatctcagaattttgggaggccgagataggaggattgcttgtggccaggagttcaagaccagcctgggcaacatagtaaaacctccatctctaccaaaaaagatttttcgaattagctgggctcggtgatgcctgcctgtagtcctagctgctcaggaggttgaggcaagaggaacacttgagcccaggagctcaaggctgcagtgagctatgatcaggccactgcacttcagcctgggcaacagatcaagaccatgtatcttataaaaaaaaacaaaaaacggtggggggagccgggcgcggtagctcacacctataatcccagcactttgggaggcctaggcgggcagatcacctgaggtcaggagttagagaccagcctgacaaacatggagaaaccccatttctactaaaaatacaaaattagctgggcatagtggtgcatgcctataatcccagctactcaggaagctgaggcaggagaatcgcttgaacccgggaggcagagtttgcggtgagccgagatcgcaccattgcattcctgcctgggcaacaagagtgaaactccgtctcaaaaacaaaacaagacaaaacaaaacaaaaggacctaaggcacagagagtttgagtgacttgcctaaggtcacacagctaagaagcagccaagcctcagggcttttgtctactctgaatggctattctccaccacccaccccaccttgctgccaactctctgctcggaccccagcacggtctatgaattcaaaccctaaccctttctagagctttgggcaaagccaggaaattccatgaaaccccttcaaggcctgggttccagttcccccaactccaaaccaaaagagagcaaaactagccctccttgcaaggtggctgtgagaaaacagtgataaaaattaattataggacttgtatgtaataaaaataattgcagggctcctggcaaacagcccagctctagagatacggactgatgatagcaggcatttatggccctgcggcccagcctttctgaggctggggtgataggagccgggtcacgaggtgggggtggtcacaggcaggaaactcccagcagcaaggcctgggcctgtctctgatgcagcctgcacattggtttcagggacgcttggaaggacactcccctagcctcggggggtcaccattagttatccatctggttgggtctgatgttgcttgctgtttgcctttctaaaaacctacaaacaaggccaggtgtggtggctcacacctgcaatcccagcactttgggaggccaaggtgggtggatcgcttgaggtcaagggttcaagaccagcctggccgacatggtgaaaccccatctctactaaaaatacaaaaattagctgggcatggtggcgggtgcctgtaatcccagctactcaggaggctgaggcaggagaatcacttgaacccgggaggcggaggttgcagtgaaccaagatcgtgccattgcactccagcctgggccacagagtgagactctgtctcaaaataaataaatataaaaacctgtaaataatgagcactttacagtgacttcattcattcgttaattctcaaggccccaaggataggcagggagcagatattggtggtggtggaggtggagcaaggcccagaggagacagtggttcattcttcctctatccaatggatatttattaagggccactccatgccaggtgcctcgctgttggaaggtagtgacagggacaccagggacttgcccaggatcacagtgggtgggagaaagtcagggctggcccctgggtcctcaacaccaaggacagtagtctcattgccacaaaaagagaccggagtggtttgtccctttggaaaaatgactccctcttaggattctagccttccctgcaggcattcatagttaattcttaaagacatcaaaaacccatattagaactccagtaatttttttaatgaaaacggaacctacttatcacaaaagctcaaccaataaagagaagtacaaataagaaagttcaaaatgtggaaattttactacccagagaaaaatgctcttagcagaggtagcagagctaagtggtcaagagcacagactcagaccaaagtgcccagggccacgtgctggcttgcaacctaaccatgctagagtgtagcctctctgctgcctatttctttacctgcaaatctgtataatggcagcacctgtcacacatagggtattaaatgttaggagcatgaaacaagctaaccatttgtggagtgcttagcacagcactcaacacagaataagtgctatttaaagggttgttcagtgtatccccagacggggctccatgcagacataccacacctgcttatggtcttaggacctgattttatatatgtatatacacatatatatgtatatatacgtatatatatatgtgtgtgtgtgtgtgtgtgtgtatacacacatatatacatatatgtatacacacatttatacatatatatatacacacatatacacactaaacaagatattccaggcacattgccatgtctataagcttctttctataagtaagaatttgatttaggctggagacagtggctcacacctgtaatcccagcactttgggaggccaaggcaggaggatcacttgagcccaggagtttgagaccagtctgggcaacttagtgagacctccctaaggtgttgcaatgtgcagctgtagtcccaactaattgggaggctgaggtgggaggattgcttgagccttgggaggtagaggttgcagtgagccaagattgtgccactgcgctgcagcctgggcaacagagtgagaccctatctcaaaaaaataaaaagaatgtacgtttcatatcggtagaaactttctggctgtttcaggtcctaaaagagtgcttggcacataatagatgtgcaaaaaaaaaaatgttgaatgaatgaatgactctaatttagtcaatatccatgacaaagggatctgttacatactgggtgtgtgactttgagcaagtatcttcaagcctctgaacttcagtcttctcctaggtttcatgggtatgacacagataacatgtactgagttaactctgtgctgggactaatttgaagtggtttatatggaatatctcctttaaaccatacaacagcatttgaggtactattattagtccatattaatgtggagttagctgaggcataaggagattaagtaacttggctaaggtcacaagtaagaggtggagctaagagacaagtcccccaggcctctgataccacagtgcattcacttaccaccactctatactgcttttctaagataacccacccttggccaccgacagtagaaggaataagtacatggtggtacatttgtacaatagaatactatacagcaattgagtggctcatgggctgggaaccgtggctcatgcctataatcccaacactttggaaggctgaagcaggtggattacttgagctcaggagtttgagaccagcttgggcaatataccaagacccccatctctaaaaaaaagaaaaagaaaaagaatactatacagtgattaagaagagcacattgatgccaggtgcggtggctcatgcctgtaatcccagcactttgggaggccaagacgggaggatcatgaggtcaggagtttgagaccagcctggccaacatggtgaaaccctgtctctactaaagatacaaaaaaaaaaaaaaaaaaaattagccaggcatggtggcacgtgcctgtaatcccagctacttgggaggctgagacaggagaatcacttgaacttgggaggcggagattgcagtgagctgagatcatgtcattgcactccagcctgggtgaaagggcaagactccatctcaaaaaaaaaaaaaataaaatgacatcctgaatttttatggcaaccctaaagtttgcatatgtatgattccatttatgtgaagttcagaaataagcaaaacgaataaatggtaatagaatcaggagcatggtttcgttgggtgggagtaggagtgagtagaaaggatattagaaaagctttacatcttgatctggatggaggttacctgtgtgtatacacatgtaacaattcaccaagctgtacacttaatgtttttaccttttacaacacttgtgaattacaactccataaaaaaatatttttaggccagttgcggtggctcatgtctgtaatcccagtactttgggaggtcaaaggccagcttgggcaacatggcaagaccctgtctctacagaaaaattaaaaaatcagccaggtatggttgtgcatacccgtagtcccagcttcttggaaggctgaggcaggaggattgcttgagcccaggagatctcggctactgtgagccgcaattgtgccactgcactccagcctgggcgacagagtgagaccctgtctcaaaaaaaattatatatatatacatatatatatatgtgtatatatatgtatatacgtatatatatatgtatatacgtatatatgtgtatatatatgtatatacgtatatatataatacacaaattttttaaatcccacagagcgatatgccctattataaaatctttgataatattctctaactgatgggatgtttgcaaggttaaaatgtgataaagtttgtgactctcttgctacattttaggctctcatagtaagaactcaatgttaaatgtaaacagcattgttaaatgtaacagcagcattcatacagcatcgttattatcatggctttttgtatttctctctattgctgatagactggagcgccctcgagtgtttaatttgttatagtacctcagttattacaaagagcaccctaaacccaagtttgtagtctcaatgccaaagggcaatgcttttcttttctttcactccagtgccacataaaaaaggaccaaaacatgacctcctgggagcaaagaaacaccaggttgcctaaggagaggtgaactggcccaggctggaaacagagcaggtcaaatctcacgccctgatcagtggtgggatcacgcctgtgaatagccactgcagtccaaactgtgagactctgtctcttaaaaaaaaaaaaagtagcaaaattcacatcaaatcaatgggtcccaaggccaactcaagccctgcccatggtcactccctgaaatgtgtcagaaggaaggcagaagggaacacgcagctctacctccctttgatgcaagcacattgcaaatatcatctcgtttcacaggaactcacataatatttgaatgtggcatcatactgactacaaaaatcctttcatattactaatagtcacagctagctttcagtgacagtttcctgtgtcccaggtaccctactaggagctagatgtcattgttagctttgatctttaaaatggcctgtgaggcatatattcttttgtagcctgcttttttcccttcagcagtacgctttgggcatctttccatgtcaataaatagagctgggtcggaagtaactgattcaaaggctgagaaacttaaacagtcagcagccactgcccaggtgaagatcaataatagttaacatttattgagtgctttattacacaccaggccctccactcattgtttaaggtgaactctctcgcatttgatccttgaggcaatcccaaggtagcttctattattattcagatggggaatctgaagcccagagaagcaaaggaacgcagtcaaggtcagacagctggtgttcaatggcagaggtgggattcaaacccaggtccctctgattcaggcgctgggctctcagccagcacatttggaggacaacatggaggaggatgtaaggggagtcttcgaagtgggaaaaggatccactagcaaaggctgaagacaggcaggagggtggtgtgggcccaggccactgtcctccatggaagtgacagtaaggcttcctggaggtgacaccgtttggactaattctatgtctccagacaataaaggaggtctttttatagcttaccagttcctgggcatacgtccagtgagacatacgtgggttcaaatcttcattgtgccactctagtttaaaaaaaaatcagcattatcgccagacacagtggttcacgtctataattccaacactttgggaggccaaggcaggcgagtcacctgaggtcaggagttcgagaccagagtggccaacatggtgaaaccccatctctactaaaaatacaaaaattagctgggcgtggtgatgcacacctgtaatcccagctactcgggaggctgaggcaggagaatcatttgaacccagaaggtggaggttgcagtgagccaagaacgtgcctgggtgacaaagtgagactcagtctcaaaaataaaaataaaaaataaacagcattgttgagatataatgatgttcaataaactaaacatacttaaattgaataatctgatgagtttcaacatatgtacatacccaaggaaccatcaccacaatcaagatgccaagtgtttccatcgcttccaaaagcttcatgctcgtttataagccatcccccattcatcccaccaccccattcccaggtaaccatcaccaatataggttgctttctttcactatagatggctttacattttctgggattttatagaaatgaaatcatgctatatgtactctgtcttaatttttttttttttttttttgagacagagcctctctctgttgcccaggctggagtgcagtggtgaaatctcgggtcactgaaacctctgccccccaggggttcaagcaattctcctgcctcagccttagtagctgggatcacaggcgtgcgctaccatacctggctaattttttttttttttgtatttttagtagtctcgaactcctggcttcaggtgatccgcccacctcagcctctccaagtgctaggattacaggcgtgagccgctgcgccccgcaaatatgtactctttctgtctgacttctctcattcaggcatgaaccaccatgcctggccatttcgccattacttttaacggcaaaaaccgcaatcacttttgcaccaacctaatagatctcacaggtgaagcacggtggctcacacctgtaatcccaacactttgggaggctgagacgagcagatcacttgagcccaggagtttgagaccagcctgggccacatagcgaaaccgtgtctctactaaacaccaaaaaattagccaggcatggtggcatgtgcctgtctgtagtctcagctactcaggaggttgaggtgggagaatcgcttgagccctaaggtcgagctgcagtgagccgtgatcgcaccactgcactccactttgtctcaaacaaacaacaaagaaagatacagaagccatagtttcttcacccatgcccctgggcatgtcattgtttcccccagtttttgcctattacaaataaaactgctatgaacactcatgttcatgtctttgagaggacaaacgctttcattatgcaggaatacaattgctggtcacataagtgtgtgtttaactttttaagaaactgcaaactacttcccagtctggcctttttaattatagtcattttagatgcactcattttttttaacctgtggatctaatagatggtttcttagactgtctggacctcagtgttttcatgtgtaaaatggagataattggccgggtgcagtggctcacgcctgtaatcccagcactttaggaggctgaggcaggcagatcatgaggtcaagagatcgagaccatcctggccaacatggtgaaaccccatctctactgaaagtacaaaaattagctgggcatggtggtgtgcacctgtagtcccagctactcgggaggctgaggcaggagaatcacatgaacccgggaggcggaggttgcagtgagtcaagatcgtgccactgtactccagcctggcaacagagcgagactccatctcaaaaaagaaaggagataattacatcagttttgaaaggtagtgaagacagagtgaactagcacataagcacatatgcagcacatagaacagggactgggacatagtaggggttccataaacggtgggtttttgttgttgttgttgtttttgagatggagtctcgtgcagtgttgcaatctcagctcactgcaacctccgcctcccaggttcaagtgattctcctgcctcagcctcccaagtagctgggattacaggcacgcaccaccatgcctggctaatttttgtatttttagtggagacaaggtttcaccatgttagccaggctggtctcgaactcctgacgtcaggtgatccacctgcttcggcctcccaaagtgctggattacaggtgtgagccaccagcctggccaagggtgattattttattacaattgaaccacagccatcctatgatctggccacttaccccaggatacagcatcctcaactagatggcaaaaagccacttcctttgcacttagtcagtgctgttagcctggaggaataacaatggcaccatcgattgtgccaggcactatcctaggtgcttttgtatgttgaatccttgcaaagccctgtgaggtgggtcagtgtttgccttctgtatgacagatgagaaaactgggatgtagtaactagtcattggccaaggtcacacagcagtgaagtaatggtgctgtgatttgaatctatgtagtttgatttaggatctagaagtttcgctaatggattacctagctcagaactagtgaaagagcccagtcacaaaagcacctcctgatgcccaaaatcattttcagctcctcagacacagagcctgaagcaaagattaggtactgtgtgatttataaaggaaagaacctgtaagggatgaagggaagcaagacagggagggaaacaagaaaagatgtggtctcaggtaaagtctagcaaaaaggctggctttgtgtacctctgtacgagtcagctgttggctgccagccaccctgtgggtgaggggaataaactccagggtgaggtgattcctgagatggcagttctccgtagaaatggaaatagtaagccattcgaagccaacaactgaagcatctggggggatggtgttggtgtgctagcccatgaagggctcaagaggttcccagaggcacacttcttgcctgcctaatgaatcaagttctagaacattctggaacattcacttcctagacttgttttggagaatcctccttctcactgagaccagcatgttgaacaaacccagcctgtgacataatcaaagcataccttaatttgtatctcccagtgtcctttctaagatgtatttggtagagaaacattttccctgccactgggtgaaatctccccattattcttctgcttgttctgaggaaacaggcaattctatggtcactttaggtcacaaacacaacctcaatttagaaatgagaatgtccagtcaagcttctaaccaaaattcccaatttgatttgggtttaaaccttctcccctcaccctcaggcctgcttcagggaggtggtgtgggtgactccttctctatctctccttccctcacccacccgtggggtacagtggggggtgttggagatggcaaggggagaggaagggtctcccttgagctgccaccatcctggctggcttcaagctgcccctttctgtcgtgggctccatggagatggccactgtcacaggggccctctcactcttaaccttgggggatgcatctctcctcataggggtcccttgcaagtccttcgtcagcccttaggaacccaacatccaactcaagcttcttgctgctgccacacctctgcccctccaggaggctctaggggacaggacccaagaggaccccttgtaggtgctctctgccaacactggcccatgggaaacactccagccagcagcctgtactccgaaagtcctgggaatgtggcttaccttagcacgcccacactggctccttcaccagttcagccaggcagcccgtttctctcagcctctagatgtccatgcccacatgagaccactgggccccctcataatggccacacattattctctacatatagtggcccctctcatggaagagcccccatgaccccattccacccttccagggagatggtcaccaaagaactctttgcttcctcttcccatcctaggagaatgtggtgggtataggggtaatagtaaatgtgggggttttgggtagccatggccaaattttagcagctgtgggtttggactgggctcttttttgttgttgttgttgttacgtaaattaacccatttattacaggccagtgatgtctcaaagagtagaggagcgtctactggtctttcaactccttcaggcttctgatggcggactttaccgtgatagcggaggtggtattgtatgtccaggcaccgccagccactgtcttcacgcgggaaccacagtgccagatccccgcagctcatctcttcatcttggttttgccacagaaagagcaagtgtacttggcctgctggctgatttcaactttcttcaccattttccagagggaggccccatagcgggtcccgtatttaccgacgatcccgactttcttggtaggtttggccatgtcaccgcgaactaggtccgagcccagagagttggactgggcttttaaaaaacagttactggttgtcacagcagagctttctagaaacatcttacaagtcatgtccaccacccccagcctcagttttttcatatccttactgcgggtggcagcaccttactgggtgggggtttgtggtgagggctgagtgaagtagtgaatttgcggagctaacactccagaattccacaatcacagacctgcaaattccatctccgtgggaccatttacaagtgatgtggcttctctgagtctgtttactcctttgttaaatggaagagcctctactccattgcatctctgtaaggttagttaagtgaatacatatgacatgcttagcacgggacctggcacctggtaagaactcagtccatgctgggcgtttttaatacaacggtgggtggctggtactgacggaggggatttgggatctccaccccttccgtttccctcactattccaggccctgttttggaaatgcttcagccaggctgggatccagggcccctgggaacagagaggacatactgtacctccaagcagccatgctgactcaggttaggaaatcaatgtgtgaccacaaaaacacagccaggttcttcccacttctgggaaatctgcacagccaacccatgggcatctctttaccctgtcccgagaggtggccagcttcgttctaggacctgattctgcagcttgtgagcacaaggctggcacatggagaaacaggagtctctcgctccttagggaaccccaggcccggggtcacaagctttgcacgaccctctgattggggtcaaacatgtctggtgtttgcgaagcctctgacttcccccagcctgcgtctggacacttctcaagccaagccaggctccggaccactggttgggcaacgcatgacctcaaactgggtcagacccatcagatgagcatctgtttaagagtataggacactttgttctttagaatcccaagggtcagagtatgaaccctccccgtccccaattcaaactcctcctccatcacttactgccatttacttactctgttactttgagcaagtttttcagctctctgagttctagttttcctagccaccaaatgcagactaacaagtaccttcaccttccagggttgatgtgagattcgggtagtgaatgtcaaagaatggcacacatattagcaggcactccataagggggagttattattgcaaacaggggcactagacaccaagtaaaaaacagtatggtacatatgctacagtggatgagagggcagagctgaaagccagactgcctgggttccaaaccaggctactggccaggtgcggtggctcatgcctgtaatcctagcactttgggaggccaaggcgggtggctcacttgaggccaggaattcgagaccaacctggccaatatggcgaaaccccatctctactaaaaatgcaaataaaattagctgggcgtggtggcatgtccctgtaatcccagctactcaggagactgaggcaagagaatagcctgaacccaggaggcagaggttgcagtgagccaagattgtgccactgcactccagcctgggccacagagtgagacgctgcctcaaaacaaaataatacaaaacaaaacaggctgccctgccacctcctgtgtggccacagggaaagtctctaagcctcagttttcttctctgtaaaatgggaataatcataatacagttataaggattcaattagattagttgcactggaaacagtgcctggcacatagtatcacctaataaccattaacgattttttattttgttttatttttccagtctctgccccagttgggaagcatgaactatttttaattagccacacaagttagtaatgtcggtaatggtgctgaaatcacacgggtcagtgttttgaacaaaattcacatggaagtcatatttagtgagcatctacctacatacctggtgctaacagaaaccatacatttagatacatgtatatgtacatgtaaacacacatatgcacacacacatagtgtgaagtaagtgttgctgtcctcattttttaaaacctttatattatagagcaaaacagttgcagaaaaccacacaaattaaatttgtagcagccaggtgcagtggcttacacctgtaatcccaccactttgagaagccgaggtgagtagatcacttgagctcaggagtttgagaccaacctggggaacatggcaaaacctgaaatgccatctctacgaaaaatacataaattagccaggcatggttggcacgtacctgtagccccagttactcaggaggctgaagcaggaggattacttgagtctagggaggtctgaggccacagtgagctgagatcacactactgtactccaccccaggcaacaaagtgagacactatctcaaaaaaaaaaaattgtagcttagtgagttatatcaaggcaaacaccctgtaaccaccaccccggtcaaaatacagaattttttcagccacctcagggttcccctccccacctcaccaggtactccataccaatcacagcccatccccccaaaataatcactaatccgactattaattacttccttgcatttcttcatgacttaatcatctgagtgtgcattcctagatgttattgtttagttgagtccactttttatttttatttatttattttttgttgagatggagtctcgctcaaccgcccaggcagtggcatgatctttcttggctcactgcaaccaccgtctaccgtgttcaacagattctcctgtctcagcctccccagtagctgggattacaggcacccaccatcatacctggctaatttttgtattttagtagagacggagtttctccatgttggtcaggctggtctcgaactccggacctcaggtgatccgcccgcctcagcctcccaaagtgctggcattacaggcgtgagccgccactcccggctaaacatatttgataagtttcaatcaactgcaagtattgtctttgttgcagctaaaattgtttcatccacaggctggcttgtaagtccttttggtgtgaccctggtagccttcgatagcttccttgttaattggcgtgacaagatattccaggcttattttgtatatttcctgctacagatctggaatgagtaatttcttcaagaagtctttttatttgtattaatcaaaactattatctgggtgcaagatatgctcattgctacaagattgattatggtttaagtctttttaatagctagaactaggtattatatatatgaatacacgcatatacatttcctttaaaaatagtttcgagttcacattgatatatccaatgtaaatagagttttataggatgtttatggaatctattctgtattacacctgtagttcctttcttccacacttggaatctttcattttcaaggatacaggggctgataaaatggaaagatgctataattactggttaaaatgactcagtaattcacaggggttaaaaactcctttaaaccttaggttgtgtggcaaacaccttacactcgcccactactggagttggcaaacgctttccagtttcagctgctgttttcccaacaacacgtgaatacatgttgcaattttagcactctccatgtctcaggcccgccagacaccttgctgcttcccttctgtttctactgcacagagatgccaatggcatgcaggccttgtagctgttggtgatttgtccccacacgttttttggagttcatgaagatgccttgtcacttagttttgttgtaaatgtgtttatgaatttttttctatttttatttggggatttggggatattcaaatctatgctaggcattattgcctccatctttccagaattccccagctggtattattttcaccaatgaggaaactgagccccaggggaaatgtgatttgcccaagatcacacagccagtgacagcgcagagatgcatgtgaggtcacctgctttcatgcaaggtacagagaagatgcctgatatggaccactccctcctcatcttcctccctatttccactggtcagtgtctttacaggattctggggggtttggtggggggcttttttgtttgttttttgaggtggagtcttgctctgttgtttaggctggagcgcaatggcacgatctcggctcactgcaacctccacctgccgggttcaaacgattctcctgcttctgcctcctgagcagctgggattacaggcacccaccaccacacccagctaatttttgtatttttaggagagatggtgtttcaccatgttggccaggctggtcttgaaatcctggcctcaagtcatcctcctgcctcagcctcccaaagtgctgggattacaggcgtgagccaccgtgcctggtcccatgattctgttattgacaatcaaatgaaactatccatgcaaagagcttatcactgtaccaatgaaagcattcagtgactggtagcagttagtataggattttatggttgatgaaaccaagggttggagagacagataactgttccattgttacacagctggtaagtgacacaggctttagactcaggtctgtctgaccagaacctaacattctttctcccacactagttcttaattcagagcagctttgtctcccagctggtatttggcaatgtctggagatacctttggtttttatcactgtgaatgtggagtgctactgtcatctagtgggtaaagcctaggaatgacattaaacatcctacaggacaacatctctcccatgcccccgaaacaaagacttttccagctccaaatgtcaatagtgctaatgttgagaaattatgccctatactgtggtgccatcctaaataagccttgccaggcagggcacggtggctcactcctgtaatcccagcactttgggaggctgaggcaggcagatcatctgaggtcaggagtttgagactagcctggccaacatggtgaaacccgtctctactaaaaatacaaaaattagccgcgcgtagtggtacacacctgtagccccagctactagggaagctgaggcaggagaatcgctggaacccagggggtacaggttgcacagagtcgagattgtgccactgcactccagcccgggtgacagagtgggactccatctcaaaaaaaaataaaaagaaaataaataaaactaaataagccttaccttagaatcaatactaaggctggtcctaggagattttctgagctcagaatcacaggccctgaacagagacagctcaggcatgtctagcctcctccagcaggtatgcaatgcaatgtcaagatttttttcttcagaggctggatgaaacgaggagagcaagatgtttgaaaccttccaaaccaagacacagggcaagccgccccctggtgatctttctgcttgagagggggtgatcatcaccgataaacagacatttcatgatacaatgtgccagaactctgcacatgccattcttttttttttttgagacagagtctcactctgttgcccgggctggagtgcagtggcatgatctcggcttactgcaacctctgccccccggtacaagcgattctcctgcctcagcctcctgagtagctgggattacaggcgtgtgccaccacacccagcttgtttttttgtgtttttagtagagacagggtttcaccctgttggccaggctggtctcaaactcctagcctcaagtgatccgcccgcctcagcctcccacagtgctggggttacagatgtgagccaccgtgctcgacctgcacatgccgttctatgacatcctcccaaggatcccctctaaacaaaggccatatccccattttatacataaggaaatgagtcttttcaagaggttgttcagactccataaattctgagtgtccaaggcagagaagacagacatcaaataccagctcaaacacttagtcatcatgtgactttgggcaattttttgtccttctctgatcctttttcccaacctgtagaaacagagacagggctacatgacctttaggacaaagtaaaatttgggaccatggtgtcatacaggcttgaattgatacctagctctctctttcatatcttgagcccttaggagactttctctttctgaatattttacattattttattttattattattttttgagatggagtctcgctctgttgcccggcctggagtgcaatggcacaatcttgactgactgcaacctccacctcccgggttcaggtgattctcctgcctcagcctccagagtagctgggattacaggcgcctgccaccatgcctggttaatgtttgtatttttagtagacacgggatttcaccatgttggccaggctggtctcaaactcctgacctcaagtgatccaccactttggcctcccaaattgctgggattacaggcatgagccaccaagcctggcctctttctggattttagtttcctcttctgtaaatgggacaatcctagctcgctgttcacagggtcattgtaaggtgaaattaagatcatacaagcacagtgcctggtatatataattcaaaaagcagaaactctttttgttgtcattgtttatcggagatgttctaatcctgatataatctggttctctaaaatgtaataccaagaggaacaagaaataatggccctcagttgagggaagaggcagggatttctggggcatctctgaatcctctccctgccctgcccttgagaccaagttcttctcctgctggcaacatctaggattgccatctgggctccaggtaccagtagtaggtcctaggtttgggttaaggagaggggtgaatttattccaatacctaggacagcctggttaggacagggtcatccctcaccctttgccacaagagctgccatttggcagggcgcaggagaatggcttgagcccaggcagcctcccaggtggctgggattacaggcctggctaatttttgtatttttagtagagacagggtttcaccaggttggccaggctggtctcgaactcctgaactcaggtgatccacctgccttggcttctcaaagtgctgagattataggcatgagccaccacatccggctgttttggggggttttctttttgagacagagtctcgctctgtcgcccaggctggagggcagtggcatgatctcggctcactgcaacctctgcctcctgggttcaagtgattctcctgcctcaggctcccgcatagttgggtgtgacagccggaagtgggggcctcggattacaggcgtgtgccaccacgcccaactaatttttgtatttttagtagagacagggtttcaccatgttggctggggtggtctcatcatactcctgatctcaagtgatccacctgcttcagcctcccaaagtgctgggattccaggcgtgagccactgcacccggccttaccttacgttttaaaagatctcacagatgtgattaatgtaaggatcttgagatggtaagattatcctggattatctggctgagcccaatgtaatcccaagagtccttataagaagagggaagcaggaggatcagtcagtagtagaggtgacaacagaagccagaggttgaggtgatttgaagaaggggccataagctaaggaatgcaggtggcctctacaaactgtaaaaggaaaggaactgatgcttcctccaaatccccaaaagaatgcagccttgccaacaccttgattttagacttttgacctagagaactgcaagagaatatatctgtgttgtttcaatccatgaagtttgcagtaattccttgtaacagtaacaggaaaataatacatagatttagcaaacaaaacaaaatccaggatgcccagtagtcatatttgaatttcctataaacaacaatttttaaagtataaatgtgtcccaaatgttgcataggacacacttatctgtgtgtatgtgtgtgtgtgtttggaaaggaacatgcttaaatgtttatctgaaattcaaactgtagtgaatgttatatattttgtctgtcaatcttagaagtgatgaaactgagagcaggagtcaaaactcatgattcccaggtcgcctccatactgctgccccctgcccctcaatctggcagaaactgccacgttcttgtggccctcatgggtcacttcccatcttcttgggactcctcttgcccctggggtaggaaaatgaaaagactgtttaaggtcgtttctttaggctcagagttctcctggaccaccagaggttctgcctcagagggacctaggagatttgcctcaaagttgcagttgcacaaaatacttgcgggcggatcttaatggactggggtgggagttagtaaagcctttgtctggagggaacgtaatgaaccccaaagcaggaaaaaagtaattattgaatcaggctccagagcaagaatcaggtttcaggtaaggaaacggaagcacaagaaggaatggggacttgctccaggtcactcagttaatgacagacagatgtcccctggtttggagtctccctttttggagcagctagtcctgatagcagccatagtggggggaagtctagaatgctaatcctgaggtccgggtttgaagccctttactgccttgattgccagtttccctttcctgaaataggggaattgcataaatatgaggagttaatgagatcatggatgttaaacaacaggtacatgttagcatgttcttggaaaatggcagcttctttccttccttctctgagcctcagtttccccatctataagccgggtttgacaagcggctggtgccccagctcctcccagccactccaggtccgcagctcggagctccggcagccaggtggggactgaacaccaacgccgcggggaggcgtcgcacatgcgcgctcctaggcggagccccgcctcccacgccctggatcgtcacttccggcgcgagaggccgggcaggccgggcagggagtgcgggtcggttctgcgtgcgctgccggacgaggctcccgccgccgattgacccgcgctccgcccgtagtcgggccggtgagtgcccgcgagcccatccgtgtgccctgggagctgaggagagggacccctgagagggaaggataaccggaagtggggaccagaggagcgagagaccccaggaaatggggacacctggggagggggtgacagccggaagtgggggcctcggaaggttgtccacgggatatggggtctcgggggctctaggagagatggcttcctgacctctccttgttgagaggaaggggtggaaaggaaagtgatgctccagaaaggatgggctccaggtgggggagatctttggcttcaccgttaccaatggtgtctgcatctcactcatatgtccgcctgtcagctcattcaccagcctgtgactgagtcctgctgagcgctcggcactgctgagtccctggagagtcaacatgaagctccaggtggagggtacagattagaagcccagggtggggctagacgcatccttgctctgcctcaccgggtgtgcccccttgggcgaatcgcttaacctatatcctccgctgatgtgtacagaccactgccatgtgcccggcactgggggtggcagtggacatggcagacaagccctctgccctcgtggaacttagattctaggggacagtcctttttgtcctcctttgtaaaatggcaacagtaatagcgctctcaccaaataacgtgaagattaaatgaggaaatgggtaaagggcttagcaatgcttgatacatggtaaaatgctcaagtatgcattctcttcattccactataatgtaagctttattaggcaaggaattgtattgtttgcgtctgtgttcccagtgcctgtgagcacagtgcctgacatatatggtaggtgatcggtaattatttgataaatgagtgcgtggtgaaactgactctagataaatgcccatagcattggactgtaatttctaaaaaagaaataggaacccagttctgtggaaaactggagggaatcaccctcagggagtttgggaaggattcactgaggtggtgacatggcagctgagcctgagctgtcaagttaggaacaaattagaagaggaaattccaggcagagtgtatcagaagtgcacgagttattccaaggatgatgggttattagtttgttttgactggcatttaatgtgcatcaaggtggggtgcgatggaaaatgaggctggagaggggctttgaggtgaggcttgtaccttgtgaacactgatgtttgatgggattgcaggcatctcttggttacttccatagaaacaaagccatagttgttccattcctcacttagcatacctgtgccaaccagactaaagtcattcaacaaatatttatggagtgcagattatgtgtctaacaccatgttaggcgctgggtttcaggtgatgaacaagacaaacttggatgttgctcacaaattgccaacagacaattgcaacagggtgggagaagtgcgggggaggcacctaacctggctgggggtcagtgaaggctacctactccaggccaccagcatctctcagctggattattgcaatagcctctaaatggtctgcttcagtcctcactcccttagagtccattctcaagacagcagattggtccttttaaaatatatttttatttatttatctatctatctatttatttatttatttatttatttatctgagatagcgtctcgccctgtcgcccaagctggagtgcagtgacatgatctcggctcactgcaacctccgcttcctggtttcaagcgattatcctgcttcaacctcccaagtagctggcactacaggcccgcaccaccatgcctggctaatttttgtatttttagtagagacagggtttcaccatgttggccaggctggtctcgaactcctgacctcaggtgatccatccacttcagcctaccaaagtgttgggattacaggcataagccaccacacacagcccaagaaaaaatttaaaaattagccaggcgtggtgtgtgcctatagtcccagctacctgggaggctgaggcaggaggattgcttgaacttaggagttcgaggttgcagagagctatgattgcgccactgcacttcagcctgggtgacagagcaagaccctgtctctctcttaaacaaaaaagtgcatgagttcaggtcctctaagaagcagacactaggatgaggttagacgtgctagaaatgtagaggcaacccttgcgaaggacagcacctgggaagggagctggagaagtcaggaagagccactggcagtgatgcagatcagctcctgtgaaggaggtttgggcagcaagtctctgactgcagggcagtcccaacaaaggtttggccaggccctcaagcaaacgctgcctgttagaggagtcctatgtctcactaaatcattggctaggagcagtgaggccacagaagggctgtggaaagttctggcttcccctggatagtggatctagagggacagccactggggccctttatcaattacgttttcccagcagatctgaccggcacatattcccgactgccacgataagttacatgggtgtgtagtaaaaaattcaaacagtatagtaaaaatcctctttctcatcttaaatcttcacttgtccagttctgttccaagagataaccattggtaagtttcttatatctctttccagaagttttgtgtgcattcacaagtgtatgtgtatagtttaaaaacgtgattttctgtacactattctgcaacttgcttttttaatatgtcaattcataaagatctgcctacttttcgctttttttgtttgtttgttttgagagggagtcttgctctgtcacccaggtgggagtgcagtcatgatctcggctcactgcaagctctgcctcccgggttcacgccattctcctgcctcagcctccctagtagctgggactacaggcacctgccaccacgcccggctaattttttgtatttttagtagagatggggtttcaccgcgttagcgaggatggtctcgatcgcctgacctcatgagtcgcctgcctcggcctcccaaaatgctgggattacaggcgtgagccaccgcgcccggccccctaattctttttcatgactgactagtaccccattaatatggtaatattacttaaccagtctcccctgataggcagttaagatgtttccaatcttttatcattataatcaatacttgtgaaggccatgtgcatattatgcatatatatacaagtatatgtcctagaaatggaattgctgacccaaagggcatgtaggtttacattctgaagatattgacaaatgccctccaaagaggctgtcaatttatactcccagcagcagcaagcatattagagtacgtttatttttgccaatctgaatctgagttgtttttttttttttttttttttttttttttgagagtcttgctgtggctggagtgcagcagcgccatctcggctcactgcaacctccacgtcccgggttcaagcaattatcctgccttagtctcccaagtagctgagattacaggcactcaccacacctacctaatttttgtatttttagtagagatggggtttcaccatgttagccaggctggtcaggtgatccgcctgccccaacctcccaaagtgctgggattacagcatatacattacagttgttttaattcacatttatttaatgatgaataaggtcgagcacctattaatacatttataaggaaggccctggtgtttattagggagtgtatagtctgctgtagctgctgcctgcctccctggggactaacagcagccggcctggggtcagacttgcgtgtatggtttagatccagttcattgcccccagttgagaaacactgccctgaggttactcggtttttacagaagtgttcctgtcccctacactgtactgccctaggatttgaaataagcacttgttaactttgcttagggcttctctgttggcagggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccaggtatctccctagactgttgtggggtgtgtgtgtccagtccttctgcagtgtgtccattcagcaccctgtcctcctttccaagtcccttttttacccctcctttgttatagtcaaggctcttttgattgcagataacacaaacctactcaaaccaacttcagaaaaaagggaggatttagtcgaaggagacaggagtccctcccagaaccagagagctgaaggcgtggcagcttttactagggcctagaaccaagaaccagaatgccaccaggagccaagacagccgttctccctgtctctgcctgacggtctgtgtatccttcagccacacatttctgccttttgcatatcttcttcacactttttctgtgtatggctgtcccgctcctgtgcacgtagttaaatctggcaccctctcagctctcaggtttgcctgaccaccaaattaagttcctcaatgcagattcccaatttctagtggggagcatctggtggggcctaagaatctgcccctggccataggatacaagcatgactgccagggccctctctgagccctctttgtgaataggttgaggtacaggtatcagtgcaagggtgcggactgggcagacacctggaaaggtgcctcctctgtgcctcctccaacctttccttcctttcctctattttgtgaagccactgacaggattcactttggatttgttttttgatcttagcatttcatggcagtgattaggataccttacatttctttgtcatggtggtttacgaatgggggctccctgccactaaaagagcatttagaaatactcccctgccaggcgcagcagctcatacctgtaatccccgcactttgggagggtgagggagaaggattgcttgaggccaggagtttgagaccagcctgggcaacatagtgagaccttgtctctacaaaaaatttaaaaaaaaatgctctttggggagcatttcaacacaatgaccaggggctgccagaactcaagatttctgattcttaggcctgttctcttccatgacaccaaaagcgttattaaactttggaatgttctactccattcctagcctcaacattttccatcagaccagagctgagagaaaaatggaaagtaagatgcaatgttctccccaagtaagccagggaatgagaacacactaatagccctctttcgctcattcatataaacgccctcttgaagggaagtttgatggggagtggacacctccatgcactttcctccgcctttactcattccccaaactctctttggaggctaaaccattctcttcagactttactatgtatgtaccaagaccactgttaatggcttacctgccattttaggtacttgccaaaattagtggtgtttattttaaaataagcaatgcagtgcagattttagggcgccaggagacttagaaaccagtcagcaggtttttctgctgctcctctgtactcaactcataagaatattacaacacagtcagatattacaacactgattgcacctttgcttgtgtagtttcaaccctttgcttgtgagatgaattttttccccatatgtctggagcagatctggacccctttccactgacccagcgttttaggaagaggcatacacagaaaggtttcttctcaattgggtatcagctttgcctttgttaaagctcttttgagacatgtgattgaaagggatgatatccagttacatagaggcagggttaattggcagcaacgttagacagcaagctggcacaatttggggacaaagatctttcacgagaattttgcacatatcaggtcaggtgtggtggctcatgcctgtaatcccagcactttgagaggctaaggcaggtggatcatgaggtcaggagttccagaccagcctagccaacacagtaaacggcccccgcctccccccaacccccaccccctgtctctactgaaaatacaaaaattagctgggcgtggtggcacatgcctgtaatcccaactaccccggaggctgaggcaggagaatcgcttgaacccgggaggcagaggttgcaatgagccgagatcacgccactgcactccagcctgggtgacagggcaagactctgtctcaaaaaaaaaaaaaaaaaaagttttttgcacacatcacatatcccattgttggcaaatgggaagttttatcttttaagaaagaggcacatagattttgctgggattttcttgagaacagtggttaacagtaaaaagtgggcattctcattttttttttcccaaagagaggaaagaatcattaaatacatggggtgtattaaaaaagtatccaccttggaaagaggaggggaacatagcactatgttccatccttacaatacctccgtcaaggtcgtgtatgagtcaagactcagctttttttttgagacagagtctcgctctgttgcccatgttggagtgcagtggcgcgatctcggctcactgtaacctctgcctcctgggttcaagtgattctcctgcctcagcctcccaagtagctgagactacaggtgtgcaccaccatgcccagctaatttttgtattttcagtaaagacagggtttcaccatgttggccaggctggtcttgaactcctgacctccaatgatccacccaccttggcctcccaaagtgttgggattccaggcgtgagccaccacatctggccaaaactcagtctgtgtggcaagtgacagccaactcacgttagctgaaacaaacaaaaaaacctcagttgctcagataactgaggtctagccgtatttccattcaggggcccaaactctggcactggaaagctgtccccaccactgctgtcctcaacaggggcttcactcccaggccagctctcttgcctcatggggcccgtgaatctcagactcaccgcctcaaaactacaagagggaagacagaactctttccaaagggccaggggtcctagaattgagtctccttgactctgcttgacctggcttggatcacacactgtggccagaaggatgtgctgtcagattggccaatcaatccccagtcacttgctcacctctgaagtcaggagtcaagtcagttctatccaaactgcatggctagagtgggaggaggtggttccctaaggaaaatcaggttagtgctatgaagataaggggaaatacatgatggcagaaagcacagatgtccatgaaggtaggcattatcaccctattctacttatgaggacatcggggctcagagtgaggtattatagtaacttgcccaaggtcacatagctagtaacattcaaacctcaggtgtgtctgacttcagagtgcatacttttttttatatttttgagacagggtctcaccctgtcacccaggctggagtacagtggcatgatcactgcagcctcaacctcctgagctcaagagatcctcccacctcagtctcccaagtagtgagactacagccacaccccaccatacctggctagtgtttgtatattttgtagacatggggtttcgccatgttgcctgggctggtcttgaattcctgggcttatgcttaattcctcccacctcggccttccaaagtactgggattacaggcatgagccactgtgcccagccagagctcatgctcttaacctcaacactcaattgtatttccatcacaaaatgtgctgctgtttggagttaagaaaccagctgctgcttattgttccatttactaacctaaataagagtcatggctactagaatatctttcttttccattttgaaacaacagtgatagaaaggagataaatctttgtttgaccacttatttatattaacttctgtaacatactgtcaatctcttatgaccttagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggtaagacccgtatgtgtcctgcctgtttcgtggtggctctggctttccccagggcctgtccatttactgtgggtctcacatgatacacaaactgcacatcccacacctgcaatctgaaaaacacaaaagcattatgggaagaaatttaaaagtcctatttaccacttgttctcatcagtctctcaagtactctctggagtaggtacttcagtaagacaagagtccaaaaaactagagaatttgcttgttgccttttcttggtctggaaggcagaggaagaattctcataacaaacaaaactggctgggcgcggtggctcacgcctgtaatccaattctttgggaggccgaggcaggtggatcacttgaggtcaggagtttgagaccagcctggccaacatggtaaaaccccatctctaccaaaaatacgaaaattagctgggcatggtggcaggcacctgtaatcccagctacttgggaggctgaggcaggagaatcatttgaacccaggaggcggaggttgcagtgagctgagatcgcgccattgcactccagcctgggtgagaacagcaaaactctgtctcagaaaacaaacaaacaaaaaacctaagaaattatgcttctgcgtaaggtgctggagcccctcctgccctctgtggacctgagggatatggtgttctgttgggctgtattttggtcagatgcttcacacctcatgttctgtgtttcagaacatgagtcactggggactgtggtgctccctccatatctgcaccgtgtttaacagcttgcacagtgcttttacagtcatcagggcctattcagtccctcagcgaatcctctgagataggcaaggcaaaaactatttttcctttttgatagatgggaagatggagacctagagaaaatatagcctgtcacagctgtgacaggttttgattacttgttcattctgacccaccacgtggggtgttttcccttgtaaactatggggcaccggtggtatagtagctcttctcactgattccacaaatgtttcagcccctgtggtgcaccaggtttattatttaaataaatcagtgcacatttggacattatcaaacatttggattctggctttgagccaaccctggctttccttcgctggcactccttttgatgcctcctcctgaataccttgtagattcaagtgtcaggatcaagagtgtggatcagtgttagtaccgtaagatcatctggagaggagaaaaaattaagtaagtttgggaaatgctgtatagcatgtccctttcttgtgaatttcactgtaagaatttacatgttaaaggctctgaacaggaatgcagttaaggaaactcacttgattatgcttagtggactacgtttctcaaactcatttgcctgctgtggagccctgttttatataacctctaatagcctgagaaatatactttgggcaacactgatctggaaggtctggtatttgccagatctgtccctgtagactcagactgttttctgctgtaagagcagcagctcttcatatgtttgcctctcttcttttttttttgagatggagtccaggctgtcatccaggctggagtacagtgacacgattttggctcactgcaacctccacctccagggttcaagcagttctccagcctcagcctctccaagtagctgggattatagacacgtgccaccatgcccagctaatttttgtatttttagtggagatgggatttcaccatgttggccaggctggtctcgaactcctgacctcaagtgatccgcccacctcggcctcccaaactgctgggattacaggcatgagccactacacccagcctctgtttgcctctcttctaacccagttttgggtcccaggaaagactttccctgaggtccgtcttcctagttaggccccacgtggactgtcattgaggaggccataaggatcagatcagactgatgttggggctgaaagtgaagatttaacttgggggaggaaggtgtggaaagattctccagatgttctaaacccctttgcctttcccacacaggatggtttccccattcggataaaagcagtccatgtggtgaatgaacctcgaatatttaaaggcatttttgccatcataaaaccatttctaaaggagaaaatagcaaacagagtaagtgatgatcctattgacttcagatttttcttttcctctgttgatttatttgtgacatctggtacttgtttattatttttgccctggaacaactaatttggaaaagtacagagttacagataaaataaatgaacagtcccttttgtgaggagaagatggaagagtaaatgaacaagaatttaatatttgccagtagagagagcagaaccaggatttttatcataagagcctccctgggcagtatagcaagactcatctctaaaaaaattttttaaattaggtgggtgtgcctggggcacagtggctcacgcctgtaatcccagcactttgggaggccgaggtggatggatcacttgaggtcaggagttcgagaccagcctggccaacatggtgaaaccccgactctactaaaaatacaaaaaattagccaggcatggtggcacatgcctgtaattgcagctacttgggaggctgagggaggagaatcacttgaatccgggaggcggaggttgcagtgagccaagatcatgccgctgcactccagcttgggcaacagtgagactgtctcaaaaaaaaaaaaaaattaggtgggtgtggtggcacatgtctgtagtctccactactcaggaggctgaggtgggaggactgcttgagctcaggaattcaaggctgccatgggcttgaacaatgggctatggtcttgccactgtgttccagcctgggtaacagagcagaacactgtctctaaaataaattttttttaagttatggtcattagaactgtggggtttaaaaatgctacttaagcctttccatttgcctaatatgttgtcccactgtacagtttgtggagcaattcaaggtttacgagctatgtgagtttttagcttacctcttatttaagaagggataaatagcactttgtcttcctttctgacccagaagagccaattccctcttcagcctttcccagtcccactgattgaaatgggatgggtggtatttttctccttccctaggcctaggaaggtcactgcaaagactgggccctgaattttacttgctttttctttttttgagacggagtctcgctccgtcacccaggctggagtgcagtggtgcgatctcagctcactgcaacccctacctcccgggttcaagcagttctcctgcctcagcctccccagtagctgggattacaggcacgtgccaccacgcacagctaatttttgtatttttagtagagataggcttttaccatgttggccaggctggtctcaaactcctgacctcaggtgatccacccgccttggcctccgaaagtgctgggattacaggcgtgagccaccgcactgggcccttgctttttcaaagtaacatatatagatggaaaatctcaaggaggtaagggagggaacttgaaatccagctccagattcctaggctctttccctgaagattttgattcatcagctcagggatctgtgctttaaaatccccttaggaaattctgatgcacagctagatttgcaaaccactaacttagtggcttccctgactgtatgtgaacccatgtgggtccctaaagattctgtttggaactttcaccaaagcagcctttggacaggtcttttacatctgtgaaatgcgctgatttggggcccacaatgttcttcgtttgttccttcataggttcctttattcagaaatatctattgatcaactctatgtacaagcatgttctagatgaacaaaacagaccaaaacccctgcccctaggaaaattatattctaaagggagccacagtgaattatctagtattagaatgtggtaagtgctacagagaaaaataaagcagagaaaagtatagcgtgtgtgaggtgggaagggttgcagtattcaactgagtggttagagatggcagccttgagaagctgacatttgagcaaagacaagaagtgagagagtgagccatctaggtatctgggaggccagcaaggacacaaccctgacgtgggagcctgtccggcatgctgggagagcagctaggctggcgcagctgggtcaagactggaggggcaggtggtgagaggagcactcagagaagtaatgaggctagattatgatgggcctcagagtctgaggtgggagtgctggaaggctgtacatagaggcacgactgtgattctgagtttcactgaaaagaacttagattgcagagggacaagagtgggagcagggagaccagataggaggccactggaggaatccagggagaagcgatgtggctgctgccattaattgaatagtgtggtggtgaggcggctggatcctggatatattctgaagctccagccaacaggatgtatggtataaggaaaagagaattaaggatactccaggctttctgggctgaaaaagtaagggtagagttgccattaacatttcctttcttcattcaacagatatttatttgagcacctaccatggaggagatttctgcattcctgattaacctaaggacatgtgtgttttcatttcattcccttttagttcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtgcatggggttcttttgtgatgatgacagtttggataaaggttccaaggttcattattcacagcccgggtagaccacctcctctgcaggtgagggagggaggggcactgtgataggacagtgcattctgtagatgcgctggctgcctctgaagatcatacacaattagactgctgcagtatggagaggagaatgcagctagctacacagagcagtagaggtgatatgcaaatttttacattcttgaggcccagctatacttcttggactggccttgagtctttccagtgatagccagcgatttcctcaatgtgcgcatgtgggctgggcacacatgtgttaaggacactcataaataatgtattttaaccttcagctacccttaatgaagctgcattactgttcctgttggcaaaatgtagcttgcccagtgacacacaactagccaaatactaaggatgggattcaaacccaggaagtatgacaagcccactgttttctcctgatggctggagacaaataacgagtccccagatagaagagagagagaaggcaggactctttcatagagtaagaaagaaccagaaattgactttttaactggcttcttgaaaatacaagcagtggttgttaacctctctgaaacccaagttgtaacaacattttattccagaagtaagcccagactccttgaggggtaactggagcacggcttgcccaactatggtcccaggcctgctaagctgtttctatgtcccctgtttatttggtactctgtgccccagagtagacaaaaactaggtccccatggtagatctggtgacttgatgagtcagttgagaaatactctaacacaggaggtacacttttgatgatgcaacaggttaagtacttatattgcagcataaccaccccttcaggtcagcctttcctgaggaaattgtggaacttaagttcagtctgtttctcacatatagaaaaatgaagctaactgttaaaatccttttctctcacagcagtcttatgaggcccttttccatgagtcagtattttcttgatgccccctgccccctccttacacagtactggtttggtacccatacactcaatggcaataaagtttcacattatcgcatttaaagggtaagtaataagaccctttagggtaccactcttctggggaaaacgtttttaacctaatattcatgctttttcctgagtaggtgccagccactagggatagctgacctagtaaaagacatgagtcacttgccttcaggtgactactaacttgtctttgtcagtgatgggtagaggagcaaacactctgtgcctgagagtagacaaaaactaggttcccatggtagatctggtgagttggtgatgagtcattagtgagccagatgactcccctacatgtctctaataaatcctgtctcttatattcttatggcccaagagacactgaggtctaattgaaaaaagaactcttaagccaagccctgggtttctctgtttcacctcttactgagtaaccataggcaagtcacgaacttctctaagcctcaaactgatacgtaaaaggaaggagggagggaaataatcaccaccttacaggcatgtggatactgtctgtttaatgcttggtacacctacccatctatgtggtttctattattcttcttcacctgagaacataggcatggtgtggcttgagtcatccagcagtaattaggacatcactgagttgggtgcctaggtaacaggacggacagaccaacacaacaggagtaaagagatgaacagcagcttccattaataagcataagcctactatctgttatcaatctgcacagatcaaatgcacaactcattatgtgaatactcactttagcctgaatgtgtaaaaacagccaggtgcagtggctcccgcctgtaatcccaacactttgggaggctgaggcaggtggatcacctgaggccaggagttcgggaccagcctggccaacatggtgaaatcccatctctactaaaaacacaaaaattagccaggtgtggtggcgcgcacctatagtcccagctactcaggagactgaggcaggagaattgcttgaacatgggaggtggaggttgcagtgagccaagatggcaccactgcactccagcctgggcaacagagcaaaactctgtctaaaaaaagaaaaaagaaccagttacagatttctttgttccttctccattcctcacttggctagccaaaaagaaaaagaacaaaacctctatactgagaaccaggtccatggctactctttggcaggcagtttctttgattaccaagagaaagttttacttcccaaccagataacccgcaagaccaacctagaaaataaaggagtccagcatggacctagaagctttctcccggctttaacgaggtaaaagtggcagccactgctattgcctttgatgagttcctagagcatgtccctgatctgaaagccagggccccaacccgcattccccaaggctaggcaagccctttcatagtgatgaaacataaaggtactcatctggaatgaaaggccaccctgagatctgatgactcaaaatactcccctgctttaaatgatgatcctggccttattcagaatgctgtcttactcatgcttgtatataattcagcattcacatgtataattcacttgagtcttgattagactactggttttcctactaagaggcagacttcactacttcttaaggtaggaccaagcaaagcagggacactgcctcccgacttttaaagagcatttgttacttcaaattaatatcagttatcatcatgagaaaaaaataaaaactttattggactttgttacatttattttacagtttagtattgtttgtattttgaattacattaaggcggaggatggggcactgtaatgtttttgaagtttaggacctttaaagctcttaagctgactccgctactgtaaagaaaagcagggtatctgcttcacactggcaaaataaggggctacatttccccatctgaccctcaaatcccttgaaacgctataccctgacataaaccactggtttaaaagacaatgattccaataatttatatcaagtcctgcttccctaccccacacctccaccctaactgagcctgtcccctctgtgttcctctgtctaattctgtaacaaaatctgaaatccagcctccatcagattctggctagatatctctgacctttgaatattgtcttattttagcccataatgagatcagcagctactgtcagtgctatgtcagtgctaaaaatgggttacactttgcaaaataactttattctttaacaatcttgtacactaggcaccaacactgaggctcagctgcctgtggtcataaatcaaatagtacgtactcaacaaataatagctgacaagtttgatagccagaaaacggcaaagctgggatgcaaacccaagcagtctgactcccaagcctcttaaccattcttaagagaccacctacctccattcttcttcgaacacatgtttttcctgtttgccacctgaatacgtggaaccaccatccacccagctggttaaaccagaatcactcagaaatctacctctccttcatattattcataactgccagtgttaaaattctaattgctggccaggcacggtggctcatgccagtaatcctagaactttgggaggccgcggcaggtggatcacgaggtcaggagatcgagaccatcctggctaacatggtgaaaccctgtctctactaaaaatacaaaaaaaattagccaggcgtggtggtgggtgcctgtagtcccagctactagggaggctgaggcgggagaatggcgtgaacccgggaggcggagcctgcagtgagcggagatcgcaccattgcactccagcctgggcgacagagcaagactccgtctcaaaaaaaaaaattaaaattgaaaaaaaaaaattctaattgctaagtagccctcacctgtcaatttctccccgtccctacgattccacttctctatttcacatctcatatggactgcacctggtctcatctctctaaatccattctctatatatcagcccaagtgactgaagataaaatttgttcatgacactatgaatatgttttcagccaccctcaacataaggtccaaactctttactgaggttgataaagccctttaaaattcagtccctgactacatttccccattccagctttactgaactttttttccccatcttcctgcctttaacatgcagttttatctactccagcaatgtcgtctcattttcccatctctctcttagctaacttctaagagttcttggcttaaatatcattttctccagaaagcctaccattacaccaaatacctctcctttgagttctctccaattcctaaaccacagcactaattcacattataaccacctgtcagctcatttgctctcttctctaagctattaaagtccaagacggcagagcctctatcatgtttaacactgtaccccaaaacctacagggtctagtacagaatagacagtaaatctttgttgaaagaactcttttattctacctttttgcacaccacctctcatgaaaatggttcttgacaatgccttccgtctctcatctaccaagtgtcttacctagagaaggtatttaggacttttgaataaattcaagactttgctcactagtcagaccgtaatttttagaaggaataggagcatcctgactagaagcgtgataaaacctggctatccagaaaataaagaatggctgctaactataaaagctgttggaagaaagggccttaaaatcttaaaagtctttgtattttaaccaaataccttcatagtgcaaatatgataaattcacatgcattttacttttacatactcataacaagatagtaacacagactaaagctgcagtgttttcccaagtgaatcttcattttaaccaaactcacaaagcatttatggaaattaatacatctggcaaagcaccagacttgaatcaagcagtctcaatgctacagtgtaaaaaaagtaaattaaaaaactcaagatgtagaagcagtagccatatcagcaaccattcttctagggaagggacccacatatacgatccttccccaagaactttgatgctaccccgctgaagagtttaagcacaaaacacagtgcttgtatcatataagtaaggactttcatagaggaaaactgtaatataaatgcatttttttttttttgcttttaaaggatactgcaatataaatatattaagcatggcctcaaatatccaacattttcctatcttacattttaaaccaaagttaaaagaacctacaggctttataaagaactctcttcacagcacagctgtagttcactttaaacaaaaaatgttccctttgtgctatatccttagaagtaaacataatatacagataaatgagaagtttcgattctgcatcaagcattattcaatctcaccttctgatataaacctgcatacagtcaaacttgcaaagcattcacttaatattttagttgaaacaaacttaaaaggtatatgggttttcggtgaaggagacctttgtgagttccagtggtgtccttggcactcagaggttcagctgaagtcccgactggtgaggacaagtggagccacaagggtccagacgtaaagcaggaggcagacccagctggagctgatcttgacccacacagctggccacttgctggtcatgctctgaaactttgcatcagggctaagaaaacaagagagagtcaggtagaaaagcctggtctacctgacttctatcagcctcctgcagccccccagccaaggccaagaaattctccagtgaaacttggctggcactaccccccagtagggttgaaggggaccagaggaagctgctatttttagttcttatgaccaagaactaaacagctcattgactctgcctctcaaatgacttttcttcttgccagcatgaaagaccctatcagggcaaagttctttaaatgttcctagttactggcaaaggtctagattgagatagcctccctgaaactttccttccttagtacattattacgggaaccagaatgctctgacatggccatctctatacacagaaaattagtgaacaaagatgggtcagattgctttatgtcatgattttctctctcaattaactcaactctgtaagagctcccaatgatttgcattgcaaagaattccaatgggttttaaatgctagaggggataaagtcaagagtatttaacccaacttcattatatgggtaagagcaagggttctgaggtcaggacaatggatgagattttataggccatccaagggttttatggtcttctgtctgttttgtctgtgtctcctacctgtaccagctggtcagggtcatcatgatgtacaaggaagccaagcagagcatgaggtggaataaggagtagctatactgcactccctctttctcgttgtccacagcccgccgaggctgtccatcttcttcatcactggcaccactggtagttgtatcaccaaggatgacgctgtcactccctgacagggtcagcttgtctacttggctattagtggaagtgcggatgctggaaagtgatcccaaggaagacaaatcagaaaggggccatgacaatgaactgctgccactggcctgtatacaagacacttactgctgagctgttcctactttggagactgaaagctttctgaagatcctgcttaaagttctgaactgctgcctgtcatcataagactgacgtcactgtcatcagttactacttgatgtgatggcttaattgcttaggagtttcataaaacacactatgctctctgtgtctgtttccgtgacttcacaagtgccgcttctatgattggaaggtaccacgtgccaacctccttccaactaacttactcatccttcacttctctgacttgctgtcatgtcctctggaaggccttccctgacatcacccctcactggctaggttacaagacactcctccgacttcccacagcttcctaggcttccttctgccactgcacatatcactcctatcttccttgctattcaaagaatgccttaacagtgaccttagtctatgtaattctagcactacagatgttcactaaaagtttgttaaatgactgaataaaaatgtaaatacaaaaacaggacaaaaattacatgctcgtttcaacagacacagaaaaaacatctcacaaatccaatacctttccatgataaaaacagtcaaagtagaacttcctcaggctgacaaaaggaacaaaaaacccagagctaacatcatacttaacagtgaaagactaaaaactttccccctgagatcaggaacaagacaaggatcctactctcaccatttctatccaacaatgtagtaaaattctagccagagcaaatagaagagataaatggtatccagactagaaaagaagtaaaactatctctatctgtagatgacttcatcttgtttataggaaatcctatggaatacatacacatgcaaactattagaaccaataaataagttcaccaaagttgcaggatacaagatcaatatatagaaatcaggactgggtgtggtggctcacgcctataatcccaactacttgagaggctgaggtgggaggatcgccagaggacaggagctcaagactggccagtgcaacacagcaagactgttcctaaaaagattaaaaattagctgggcatgatggtgtgtgcctgtagtttcagctactcaggaggctgaggtgggaggatcacttgagaccaggagcttgaggctgtagtgagctatgatcacaccactgcattccagcctggatgacagagcaacacttcttctcttcaaaaaaaaaaaaaaaaaaacacaaaaatcaattgtatttctttttgagatgaggtctcactctgtcacccaggtggactgtagtagtacaatcacagctcactgcagacttgacctcctgggctcaattggtcctcccacctccccaagtagctgggactacagattgcaccaccacacctggctaatttttatagagacgggctcttactatcttgctctgactggtctcaaactcctggatgcaagcgatcctcccacctcagcctcctaacgtgtgggaaatacaggcatgagccaccatgcctcgtcaccaatcatatctctatacactagcaataaacaacccaaaagttaagctaagaaaacatacattcatttataataccatcgaaaagaataaaatacttagaattgtatttagaataaaacacttaaaaacaaaataagtttaagatttgtatactaataactaactataaaccactgaaagaaattaaagacctaaataaatggtttaagtaaagaagacttcagtaaggtatcttcatggtcacagactggaagccttaatattgctgagatgacaatactccccaatttggtctatacagattcaactcaatccctataaaaatcccagctacatatttttttgcagaaattgacaagctgatcctgaaattcacatgggaatgcaaaggacccataactgccaaaacaattttgaaaaagaacaaatttggaggactcatacttcctaatttcaaaacttactacaggctgggcatggtggctcacacctgtaatcccagcactttgggaggctgagaaaggaggatcacctgaggtcaggagttcgagaccagcctagccaacatggtgaaacactgtctctactaaaaatacaaaaattagccaggcatagtggcaggtgcctgtaatctcagctacttgggagcctgaggcagaagaactgcttgaacccaggaggtggagattgcagtgagctgagatcctgccactgcactccagcctaggtgacagagcaagacactgtctcaaaaaaatatatatgtacacagctctgtaactgaagcaagtaaagaacttttcattaaagagagtgaagtttttaaatttctcatgctgctttttgaaagcaaaacagcttcttcactttattatcaacctccatgaaaatcttgttctaagtaccttttaacttacctagaatacaagaggcagagaacaaagacaaacagtccaataaaattatctgaatccagtaaagacccactctttgatggtggagtaggggtagggaccacagcagttgaatttccaggagccagggttggtgcagttatgcgtgtaataaagctcatcaggttgggattgcaggaacgatctgaaaatgagaaaatttgtattatccttggttacagctcatcttgttccaagaaagaacttgaggagttccctacatatcattcagtcatgatgtgaaacatgggaatgctttacttaaaaaatctgaaacttagcagtcagtagtaacacgtttggtcacaatcaatgacagaattaggaaaaaaaaagaaaacaacaacagaatctgtcaaatttcataaacatcattattgattttattggttttgtagtttgacaaatctttttaattctttaagtgtcaaggttttaagcacagaagtttatctctattttggtttttacatagttacttaagaacaaaatataagttatcattggtggaaggggggtctgcattgttttcctttaaaagaagcccatagaatatcctactgagaaacaatcctataataactacaaaaggagatttcctacagctgtttcttctacagcctgtgacatcaaactaaaattcagtcacaacaaagggccaaagcccttgaccacagctcttaactagtttgactcagcctaggttaggtaaagcctagaccatctaaaggactctgaccctttagactgtcagttataaatagctatcaatagatgtggggactaaaatgtgaaaggtaaatacctacaaacctacagtgaacactgtacgtttaagttttgtttgcttgtttcacatttgctctagctctagtttttgtaccaactatgtaaaggctgatttcctactttctttttatcaaatgaatgtgttattgacattcccttaccaggttcattggacatggctgaccaggtgaggtacatagtgtagagggtgatgagggaggactgcaagaggccggagcgaggctggtgttcctatggaatcaaaaggaaaacagtggcacagggactgccaagggctgactttccaaaatgcagtgcacttctctggagttaattcaactatcagtaactgagaactttcggattcttcttgagagttgaaaggtgacaagtaaccttctgttcagttagctcgcaaaagaacccagaaagaccaagcaagtactactggttctcaacgcatttcacaatcctagaaattcctgtgcatcacacaaggactttgattttccactcccttggtgtagtgaaaagatctaagatcagctctgcaactaattagtagctgggagaggcctatcacttctttgagacttctgttttctcacttttaaaaggaaaggtgatgtctagatagaattttcatatttcatatctataactccatgaatttttttaaacggtttttttttcttttttttctgagacggagtctcgcttttgtcaccccggctggagtgcagtggtgcgatctcagctcactgcaacctcctcctgggttcaaatttctccttgcctcagcctcctgagtagctgggattacagtgcccgccaccacacccggctaatttttgtacttttagtagagatggggtttcgtcatgttggccaagctggtcttgaactcctgacctcaggtgatctgcccgccttggcctcccaaagtgctgggattacaggcatgagccatcacgccaagctggagtttcgctcttattgcccaggctggagtgcaatggcgcaatctcagctcactgctacctccgcctccagggttcaggctattctcctgcccctcagcctgccaagtagctgggattacaggtgtgcgcccccacgcctagctaattttgtatttttagtagagatgacgtttcaccatgttggtcaggctggtcttgaactcctgacctcaagtgatccacccgccttggcctcccaaagtgctgggattacaggcgttaagccaccacacccagcctaaactatggtatttagaactcaagagcatgagttttgttttgaaatattaaaatcaattatttttcagtttaattcccctaaaatatcttggctaatgactcataagaatcattcccagccacatgcggtggctcacaactgtaaaaccagcactttgggaggctgagatgggtggatcacctgaggtcaggagttcgagaccagccttgccaacatggtgaaaccccgtctcaactaaaaatacaaaaattagccgggcatggtggcaggcgcctggccaaggctggagaatcactggaacccaggaggtggaggttgtagtgagctgagattgcaccatcgcactccagcctaggggacaagagtgagactttgtctcaaaaaaaaaaaaaaaaaaagactcattcccggccaggcgtggtggctcacgcctgtaatcccagcaccttgggaggccgaggcgggtggatcacgaggtcaagagttcagcctggccaagatggtgaaaccctatctctaccaaaaatacaaaaactggccaggcccggtggtggctgcctgtgatcccagctactcgggaggctgaggcagagaactgcttgaacccaggaggcagaggttgcagtgagccgagattgtgccactgcactccagcctggttgacagagcgagactccatctcaaaaaaaaaaaaaaaaaaaaaaaaaagcactataaattttcaagttacctgggtttttttttaatgatagtgaaattcatttaattatgatataggcatgaaatagaattatgaagactttataatatggaaaaatgttcaagtggataaacttagacataaattcataagaaagggtacctagattttaagcttagaattaaaaacctttcacaggagaaagaagtagtaaacaatcatacctgaatttttgggtggatcgatataatagaagccacaacgcaaaggatcaggttaatactgatgaagaacttgttttctgtgcagccatctggtttggtgtaatatgtatagagcagcccgacacagatgattgacaggatataaaaggcgcttgtgaaagacagtaaagctggagaaagggaaaccaatatgaatgaccacaactataataaactaataatgaaggccaattttcttccactccatataaaaatgaggagacattatgtcacttttctggggtaatttacagtaaaattacagaggtctcaaggttaaagtatcaagattgtattcaattggcttgatgttaaattccaaaatccaccaagcaactgaattcacttcctgaattacctgatttgatttcatgggttgattaccagacatttgatcattccagctagagtttactgctacctatatgttaattaatgtgtattgtgagcttttcttaggaacctaaatgattcctttaccctcaaaatgacccagttcacagcaagctccatgccaggatggtgttagaggaaaacagaatacacacactggtatctttttatgacagttttttcctctgcagccattggctatctaaatccatttcccatcacaaacaataagactgtccctgaactggaaaagtggctcatttgctattttttaatatctaaagtaatggtcttttccattcacactaaaaatcaacaattagctgtgttggctgaacatggtggctcatgcctgtaatcccagcactttgggaggccaaggtggctggattgcttgagcctgagttccagaccagcccaggcaacatggccaaaccctgtctctacaaaaaatacaaaaatcagccaggcatggtggcataaggctgtagccccagctacttgggaagctgaggcagggggattgcttgagcccaagacatagaggttgcagtgagccgagatggtgccactgcactccagcctggacaacagaacaaaaccccatctcaaacaacaaacaaaacaattagctgtgtagctctgaaaattagaaaacatgaaacagcacatacagtacactcagaccaactgcaagaatgatgagctcagctaacttgtattcaagtcaaagcccagattaagaaaactagtttctacttatctcaatgaattttgcatgtctaaaattaaatgatgtacattaagttactagcacacttaatgttttcacctctgaatatacaagatttttctacacttagttactgtaaagtatgaccaatttgcaactcaataaattcttctagagttgtatgatccaaaatgaattaaagaaaataacagccgggtgtggtggctcacgcctgcaatcctaacactttgggagggcaaggcaggtggatcgattgagtccaggagttccggcaacatggcaaaaccctgtctctacaaaaaacacaaaaattagccggtcgtggtggtgtaggcgtggtagtgtgggtgtggtggtgtgcacctgtagtcccagctacttgggaggctgaggtggatagcttgagccaggaaggcagaggttgcagtgagccatgattgtgccactgtactccagcctgggtgagagagtgagacccaatctcaaaaaaaaagaaaaaaaatagataaaaataaaattgtcattacaaacaatttaaatgaccaacactagggtaaaggttaaataaattatggtatactccgctatggaatgccatggaattgtatggaatggaataccatgcagcttacagtaaactccatgccaggagcttgaatgcaggttaaatgagtaagacatacctacactcactggtaaggaaggatattcatcatgtaggaagtgaaaagagcaagtcatggaacaacatacagtacaatcctgtttacatttaaatacaaaagcaaggtgaatgcataaatacataaaggttcacaagagtggctacatctggaaaggaaaatgggttgcagataggtggagatttgcatgttttagtctttataaagttctatcatttgtctttatggtaaacatagtatttttaaaaacatgtaaatattttaaaaaactaaatcaaatgaaaataaaactgcgcaattcaatagtatgtactgaaagcattttaaaatattcatacactttgactcttctatttctgggaatctgtcctaaggaaataatcagaaatgtgtgcaaatgtatattatgaagtagtaagtgctctaacatagccaaaatatattcgcaagctactgttaaatcccattatcactctagaaattgtaagtgcccctttcccaccagaaagtttttcatagcaggtatggggcccctctctgaataaggccataaggactactcactcctatctgcctaaagtaggtgggcagctgtcccatatgttgaacccatctgagtttcctctccatggaaacaaggttatcaaaaccagaactaagtcactaaatataactgtttttccttatctaaacacatgtaattaaattatgactctcaaaatacataaattgggaaaatcgaacaatttatattatctgtgctactttcttccagtgatgcatataattcagagccaaattctggaaattgtggatttttttccttttatttaatgttattattatttttagagacagggtcttgctctgtcacccaggctgcagtacagtggcatgatgatagcttactgcagccttgaactcctggattccagagattctcctgccttagcgtgctgagtagctaggactataggtatatgccaccatgcctggcaaattttttttttctaatgtaaagatggagtctcaatatgctgcctagactggtcttgaactcctggattcaagccattctcccaccttggacttctgtccctgaggactatagctgctgggactataatgatgatttttattgtacaccgtgcttaatgtagcagtatggctaacataggtgagtagagatacctaccagcataccacaaccttgggtttccttcttccattcgatttacccatgattcattccaagaatgagcaaaatctaccagcagcaccagctgaatgaggatgaagagggcggcccctatcatgccaacaacaaaccagactacaagaaccaagagaacaaagttattctctaccatagagtaacatttcagaagatccaacattctgaacggatttcaattaaaacaagacagaggtggtaaagacattctgtctccagcagtacagcaagattccaaactcaacggcattcttaaaagctttctactgggtttcagaccttttaaaatatgttttagcttgtgccaagggaagcctgggacctgagttccaaatgatactataagtcttttcttttaaatcacagtagaaatctaaagatgtcacctgatgccatgcttaggaagtaggttaagacagagataggggagcacaagagttgtaagtccttattttgacaggctctctgattagctttgtattccatcaagtgagaacacaaactattaagatattgccaaaagattaacatatggttccagaaaatctgagaggtgcagtgaatgcctcctgacctaaatccacatattaataatgagttgcagccgggcgtggtggctcacacctgtaatcccagcacttcaggaggctgaggcaggtggatcatgaggtcaagagttcaagaccagcctggccaagatggtgaaaccccgtctctgcctaaaatacaaaaattagctgggcgtggtggtgggcgcctgtaatcccagctactcgggagactgacgcagagaactgcttgaacccaggaggtggaggttgcagtgagctgagatcgtgccacggcactccagcctgggagacagagtgagactgtctaaaatatatatatatatatagtgagttgcaggtactaagtcatattaatcggataccatctcatttacttgtcagttctacaaaaacagtaattaaaaggtagttttgttttgttttgttttttgagacagagtcttgatctgtcgcccaggctggagtgcagtggcacgatcttggcacactgcaacctctgcctcccaggttcaggcaattttgctgcctcagccttctgagtacctggaatcacaggcgtgcaccaccacgcctggctaatttttgtatttttagtagagacagggcttcaccatattggccaggttggtctcaaactcctgacctcaggtgatccgcccgtcttggcctcccaaagtgctgagcttacaggtgtgagccactgcacccggcctaaaatgtagctttaactcaatcatctatagagtttatatagtttaaaattaaccccctcaatggtgaaccctacctgagctgaaatagcccccagggatgtagaaagagccaaccatgattccaataagggcagcaattttgaagaaccaaaacctattaaaatataaaaatgcatttatgaaatgctaagtttcacccttatactgagaaaaattcatttctgaaatgcaaaaataataacttaatagcttttttcccaacatgattgtctggactattttcttcatttgactattcatttaataggctaattcatttaatatttcacacaattaaaggacaacattagcctagaagataaatcactcacatttattaccagagaaaactgaaaatttagagtctccctacttttagcacttaaaggtaggcatttttctagcattctgggagttctaaaataacagtgttaggtacacacacagccattaactgttaaggtctggatgaaaagtaatcacaaatatttacaacacagggcacagataccttgcccacaatgacacagctcatcactggcacctgattttcagttcatgatctttaatgactgccttgtatggcagagtggaaagaaccaggctttggagctggacagatctaagtttcaatcttagctccaacctccaactggttaacaggtctcagacaatttattaacctctctgcagttcagttactacatctgtaaaaaggggattataatacacatcaagtttataaaacgccattcagtctttgagaattagaaatacggctgggcacagtggctcacgcctgtaagcccagcacttcaggaggcaaaggcgggcggaccacctgaggtcacgagttctagaccagcctggccaacacggtgaaaccccatctctactaaaaatacaaaaattagccaggcatggtggcaggtgcctataatgccagctactagggaggctgaggcaggagaatcacttgaacccgggagggggaggttgcagtgagccgagatcacgccattacactccagcctgggtgacaagagtgaaactccatctccaaaaacaaaacaaaaaaaaaaaaaaaaaaaggagagaattagaaacataggtaaaaggtggtcaggagtcagaagcaatagaatatgtaaatcagtagcacatatatattcactgacttttgtacactgtttaaatttatcaggtacatgtttatctttaaacaacagaaagaaaaaagtgtgtgtgtacgtagtatctagcatagtgcttcaactatttaacaggtgttcaataaaaatctaagaacatgaagcaaaggaatttaatagaagaaaataaaaagacaagaccccctatcccctccatgttacagcaatctaactgaaaatgacattaaaacaatttcacatgcataatagatcagaaatgcatctgagccactcatttacatattccattgatttcatcagaatggctatattaactgctgaagggaaggaagagccacaccataatgtaaccagttaatcataaatctaacatacccattgtgtactgccgctcggagatctttacttgtttttactttgaacatgagcagagaaaagacaaagaaaaagatggccatggcaaagctgatccgatacacagctttataaccaaccagcacatcacaatctttatctgcatttatatcagcctcatggattttaaatcccccttcacaaaatccaggaatctggaaaaaagcaatttcaatgttacgagaatatctacatttagacagagactctaacccactgcaggaaagcctggatttagaaaattaactacttcaacaactgcaagactgactatggaatttttctctttgtcttccaattcatttacaatcttgttaccaaacagtataaataacatgcattttaaaaataaaaatgctctctcggctgggcacggtggctcacatctgtaatcccagtattttgggggaccgaggtgggtggatcacgaggtcaggagttcgagaccaccctggccagcatggtgaaaaccctatctctactaaaaatacaaaaaattacccgggcatggtggtgcatgcttataatcccagctactcgggaggctgaggcaggagaattgcttgaaccagggaggcggaggttgcagtgagccaagatcatgtcactgcactccagcctgggcaacagagtgagtcttagtttcaaaaaaatatggtctctcttctttgcccttttaggatgaagaggctgtgtgccactttcctgtgagattttccagctacgactgagtccttccaaaggtgaagaactagtccagtttagatgcttcgacctttaacacataaggaaagaaaatgttttggagccacccttttaatgttttctctcagttgttcgactggagcccagatgttcattctgtatttctggaaaaggactaatgtcctcatatttctgtgttttgaccacacccccatataagtaaaaaatctccaaattacaaccaacttgattaacaacgacgaaataaaactagaattttgcagaatataaaaataaaaataaccaataccttaagggcactgttacttcttaccttcttcaagtaagtttccatctcttttctctgcatgatataggatacgacagtgctcaggaggagaatgaaagcataaatgaggcgagtcaccgtggaattcttactgttaggacagcaactacacagcaaacatgaggcaccgctgcagaggcatggaacctggaatgagcacaccatggtcacctgagaccgccttcagtatactcctttatgacacagatgtcgcagaagagaaagcgaggcaaatcaggctttatagttttaactcagagaatcatggctgggaggaagtggttaaaagtacgggctctggagtaaatattatttctgccgctttttaccccagcaagttacgtactctaaccccatttgaccatttgtaaaatgagctcaataatggaattttcctccctcagactctgctgtattaaatgagcactcaacactacctaaaatgcattaacagttcaataaatgttaattatattctgagagcatcatttgttttaaaatatgagaaaaatataaacctaactccacttgctgcttactgcgaatccaagttaccaaagctgatattacaacataaagcaacatgccgggcgtggtggctcacgcctgtaatcccagcactttgggaggccgaggcgggtggatcacaaggtcaggagatcgagaccatcctggctaacacggtgaaaccctgtctctactaaaaatacagaaaaaattagccgggtgtggtggcggacgcctgtagtcccagctactcaggaggctgaggcaggagaatggcatgaacccaggaggcggagctcacactgagctgagattgcgccactgcactccagcctgggctacagagcgagactccatctcaaaaaaataaaataaaataaaaaaataaagcaacactacatggaaaccctctgacaaataataacagcaagggccatttagctcaattcaagaggaaccaggttcctcagaaagttaaatacagaatgaccatatgacccagaaagtatatacccgaccccaatagctgttttgtttgaaactgctattaaaacaaaagcttgtacacgaatattcacagcaccactatttacaatcaccaaaatgtggaaacaacccactgtccattaattgataagtaaatatggcctaagtaaaaatatggtatatctggctgggtgcggcagctcacacctgtaatcccagcactttgggaggctgaggtgggcaggtcacctgaggtcaggagttcaagaccagcctggccaacatgatgaaatcccatctctactaaaaatacaaaaattatccgggcgtggtggctcatgcctgtggccccaactactcaggaggctgaggcaggagaattgcttgaacccaggaggtggaggttgcattgagctgaaatcatgccactgcactccagcctgggcaacagagtgagacttggtctatctatacaatggcttattcagacataatagatagatacatgatagaacacaggtgaaccctgaaaacatcatgcaaagttatttaaaaagccagacatgaaaggtcacatactgtattagtgcatttatataataaaatatccagaataagtgaatctagagacagaagattaggggttgaagggaagggaaatgggagtgatggtttaatgggtaaaggatttccctttagggcgacgaactagacagatgtgatggcagcaaaacattgtgaatgtactaaatgccactatacgcttttttatttttttttttttgagacagtctcactctgttgcccaggctggagtgcagtggcacaatctcggctcacggcaacctccacctcctgagttcaagcaattcttgtgctttagcctcccaagtagctgggactacaggtgtgcaatgccacccccagctgatttttttttgtattttttagtagagacagggttttgtcatgttgcccaggctggtcttgaattcctgagctcaggcaatccacccacactggccaccgaaagtgctggattacaggcgtgagatactgcacccggcccactaaacattttgaaatggttaattttatgtcaactttacctccttttttttaaagagtaacctagggccaggcgtggtggctcacgcctgtaatcccagcactttgggaggccaaggcaggtggaccacaaggtcaggagttcaagaccagcctggccaagatggtgaaaccccatctctactaaaaatacaaaaattagccgggtgcagtggcaggcacctgtaatcccagctactcaggaggctgaggcaggagaactgcttgaacccgggtggccaaggttgcagtgagccaagattgtgccactgcactccagcctgggcgacagactgagactccgtctcaaaaaaaaagagtaacctagatctttagtctgctaaaatctgttagtgaccacactacatgaaagaagatataattttatttctttttttcttttctttctttttttttgagacaggttctcactctgtctcccaggctggagtgcagtaacgccatctcggctcactgcaacctcaccctcctgggatcaagcaattctacctcagcctcccaagtagctgggattacagggattacagacacgtgccaccatgctcagctaatttttgtgtaaagacagggtttcaccatgttggccaggctggtctcgaattcctgacctcaagtgatctgcccgcctccgcctcccaaagggctgggattacatgcatgagccaatgcacccggcctttgttttgttttgttttaaaaagacaaggcgtcactctgttgcccaagctggagtacagttgtgtgatcacagctcactgcagcatcaaactcctgggctcaagcgatcctctggcctcagcctcctgagtacaagcaagcaccaccatgcccagctaagagaggatataatttgagtcattatgcttgattaggaaactgcttgaaattgctctgagggggtgacattatcaagtcatattacaaggacaagctaattcagaattagcagaagtaaacaatggataactctggtcttaaaatatggtcccaggaataatcttcatttttttatagatggtatcttgtgtgcactttatgataattttgtgtggtttgcagcagggtgctaacattctaaaaaagttcagttttctcatctgtaaaaatgagcataataccacctactcgaacagggtgattgagcaaagaatgagatgatgtcaggaatataaagaacctagtataatgcctgacatatttatcaggctcaatatatcgtggtagccattattatttgtaattgcaatagcaatgggaaattgaccagccagtctcagtctccaattcttaactacagtataggccaaacactgcagaggcatgtcctccacaaattcttatgttgaagtcctaatgcccaattcctcaaaatgtatccttacttggtcactgcagatgtagtaagttaagatgaggttatatggagtagagtgagcagctaattcaatataactgtgtccttataaaaaggggaaacttggacaaaggcttacaacacagggagaattccacatgccatgtgaaggcagagatctacaagccaaggaacatcaaagactgccagcaaaccaaaaaaaaaaaaagccaggggagaggcatgatacagattctctctcaccacccttagaaggaaccaaccctgctgacaccttcatcccagacttccagcctctagaattcagagataagaaatcactgggtttaagccactcggtctgtggtactttgttataaagccctggcaaactaataaacttacttacctatagttgtcttaagaatgtaaatatctcgaaggggagactatctttacaacgttatatcttttgtatctttacagagcaggtactcagtaaatatctgtgggacaaatctgtcctactatatgttatgtcatttttctatttcagtaaatgacaactccattcttcctgttgcttgggcccaaaacctggagtcatcccgaatgccttcccttttcccaaaatcctcatccaatctgtcagtacatcagctctacccttaaaatatatccagaatctgaccattttcacagtatccttagctatcacctttgtccaagccacaactatcatctctcatctggattaagcgcaaaagttcccatctcacagctgtagcgacccattcagaagctctgagttggccggcacagtggctcacgcctgtaatcccagcactttgggaagccaaggcaggcagatcacctgaggtcaggagttcaagacccgccaggccaacacagtgaaatcctgtctctactaaaaatgcaaaattagcctcaaaaaaaaaaaaaaaaaaaaaagaagccctgaattgttataaagattattttaagcttttaagctgaagcatctgagcttcaacagatgcagaggaaaaaaaaaagccttctgggagcttctcttatctgactaaaagcagcaacttctgggaaacgaggctgccataaagtccctctccagggcagttttaagatcatgaagaagctggaaagacccaccatacctgcataaacaagtactaccacaaacgtatttcctatttattctcctaaaaaaacttgtctttcctaaagaaacctatttgttcttctcatagaagcctttctcccagcttcctttttcctactaaattagaaagccttggctgggtgcagtggctcacacctgtaatcccagcactttgggaagctgaggtgggcagatcacctgaggtcgggagttcaagaccggcctgaccaacatggagaaaccccatctctactaaaaatacaaaattagccaggcgtggtggcacatgcctgtaatcccagctacttgggaggctgaggcaggagaatcgcttgaacctgggaggtggagattgcagtgagccaagatcccaccattgcactccagcctgggcaacaagagtggaacttgttttctcaaaaacgaaaaaaaaaaaaaaagcctcaagttctaaccgccccctttgagttactattactgagcactcctgtgtgtacatgtcttgcatgcataaactctaaataatctgttttgtcagtttaattcacaagcccccagaaacagaacccaaaaggctggaggaagattcttcccagcctacactgctttacctttacttttctaccatctattctccacacagcaaccagaaaccacctcgttaaaacacaggcccagatcacatcactccttttttcaaactctgtaatagattcccatataacttaagagtaaaagccgggcaagacgcggtggctcacacctgtaatccaagcactctgggaggccggcggatcacgaggtcaggagattgagaccatcctggcgtgagccaccatgcctggccttcaactcaccaggattttctaatgtgatagaagataaaagaaaaattgtacagtaaacgattatttcataaaactttgtctctatatgggtgcatcagatcacagatcaactatgtacaatctttctttaggtcaaggtcagaataattagaaaaccactgctctcaagaaagcccttaaaaatggaacactcttttgatttaggaccaacaaccttaaaatacattctgttcctaagaaatagtggaatgaagccaggcatggtgtcacacacctgtactgggaaggctgaggtgggaggatcacttgaatccaggagttcaaggctgcagtgagctatgactgagccactgcactccagcctgggtgacagagcaaaactctgtccccctccaaaaaaaaaaaagaaaaatagtagaaagagctgaaacagaatccttggtgtaatactgtcaaatatatgtatgtttggttcccatttcctggcatacaatttctaaaatccttggaataaccagcgtctttttgtatgctaatgagatgactggtgactggcagcccctaggtggcttcatgatgggtgagggtcatagtaggaggttgggacttttcagtctcacccctgaccctccaaggaggggctgaaggttaggtcagtaaccaaaagccaatgatttaatgaatgctgactacataatgaagcctgcataaaagctcagaaggacaaagttcagaagaacttttggctgggcatggtggctcacaccccaggagttcgagaccagcctggccaacatggcgaaatcccgtctttattgaaaatacaaaaattagctgggcgtggtggcatacactataatcccagctactccgggaggctgaaacatgagaatcccttggaggttgaagagagccgagatggcgccactgccccagacagagcatggaagctccagacccgttccctctacaccttgtcttacatatcacttcatctgtatctttaaaaatatattaatagtagccataaaaaaagaagaaaatcatgtcctttgcagcaacaaagatgcagctggaggccactatcccaagtgaattaatacagaaacagaaaaccaaatacagcatattctcgcttacaagtgggagctaaacactgggaacacagacacgaagatggcaacaataaacactggagagtccaagagtggggaaggacggtggggggataggggttgaaaaactacctgttggatactgtgttcactgtttgggcaacggaatcattagaaacccaaacctcacgataaggcaatatacccatgtaacaaaactgcatatgtaccctctgaatctaaaattaaaaatacataaatacacaaaataaaatacttttataataaaccagtaaacatgtttccttgagttttgtgaccaaattaatcaaagccaaggagggaggtcacgggaactttgatttataggtggccggtcagaagcacaggtaaaacaacctgaggcttgccattggcacagaaagtgggcacagtcttgtgagactgagccctccacttgtgtgatttgatgctatctccaagtagagagcttcggaattgacttgtagggcaccaagttggcatcccctgcagagctgactgtttgcctgatgtttgggggaaaatccccacacaccacacatcaggtgtcaaaagtgtgttgtgagtacagcaggagaaactgagtgtgctttttctacacacttggtcaattaaatcagctggagaatgaggaatcaaggaatcacgctcctctgaagtgggtaaatgagggaactcagcatattcttttataggccctataattttctctttaaaatgtttacagtttacaaggtgattaaaccttcacttcactgtcacaatcgttctcgaagagaggaatgctggggtgattatcctcggataaatgacttacagcagtcccaaaatattcaggccctggtttccaattttgaataacaatccacaagggcttctttcccttgcacctgaactgcagacaagcctccgctaaaaccccagctttgccacacactctgtagttttggcaaatcccgtgctaggggataaaaatattacttgagccacctagaactaaatgatggcaccttaagaggtgcttcgggaggaaccggagcccctcgctgggagctgtcattccttggtccctctccagctccagaggaacctagtcaggaagcctcgcagggcggagccatccgaattgtaaacaatggcggcctagcctcttccgttccccgaggaacccggagggcgagccgcctaagctggacctgagggtatcgcggatttgcgtctggggccccggagaccctctgtagcccagggcctgctgacatcccgagagcctctggagccaaggcccgtgcagctctggtctcgaggcctttccccgcaaaccgcaggtccggcgaggactcgggaccccgaactcacccagctggcgagggagaagacacccagcacagcccccatggtgacgccagtgatggaggtggccggtcctgaggctgctttctaacacggtggtaactgccagctgaggtgactccccagaaacatgacggtttctcaggccggaaacgcagccttccacagacgcacggatgcgtcacggcgtggccccgcccaccgtccgcgaccggagcggcagaggggggcgcctgtcattggctgagggggaaggtggggctaaaccatcctggggttgcaggaactgtgaaggtgtcattccttacatcatttgtattcattgtgcaaagatctggaagttacagaagtgtacagagaggcacagtacgctcagaatttattctctagttaataggagatctgacaacataaatgcaccgtgccccaatgtaatgaatacgatgaagtagtatgggggaataggctttcaataaaggtgtatttagtgcctcctattgtaaggggaaagtaatttagctgggcagtagtcttggaaggcttctctgaaggatttattttttaatctgcgaactaaaggatgagtccaaattaacctagaaacgatggaaatcgtatcctaaaatgtgggatgcaccccatttgggaaaaatgaatggctctaagggtgcatgaaggacattaagcgatattaaacagcagagtgagaacgtcccatttcaaaccaacaggctagttgtttgaggccagtatggtatttaacatttttctagtatttatctccctttctaacagagtaaagccttcattttccagatctctcaaacaggcaaccatgcctgcagttttaaaatattgttttgttttgaggtgtgtgttagcaataaccttttcatttcttccgagcaatgctgatttcccatttaagcagtgatgtaaatattcctttcaaaatacatgtcaaatttgagagttcacttaaagaagaaaatgaaaacattttttacttacacatataatagtttaggtggaatgtggcaaacaatgatgatgtccggacaacaaggtgtcacacttcaatatcttctcctgtggtgtgttaatcttccctgatagataaaactctctggaaggggattcataattgaattccttctggattgtcagcctttagtctgataagggaaattcatgaaaagcccctctctccatgtgctgttccccaagcaatcatcataccagtgtggcatatttggggatgttatttcctggattccttgaaaatgtattccaaattcatcttttacagaaatggaatgaggctcaaagtttgcccaaggccatgaaaagggctgatgaaagaagaaagagaactactcacatttaataattcctacctctcttttcccagatccctctcctcaccacacatacacaaataccagctcaagtcaagttgcttcaggaccactgaactttccaggtagtccttaacattcttgcttcttcctgtctgagtattgctggtctggacttaagagagctgactgtgataaattttacagatcgaattctaccagaaacatacctgtagtcaaaaagaattaggtttatttagcttgttcagaaagggagaacacatatcagagaaaatataaggtgtcttggtaagaggtgactggggagaacttattttaggatttgggtttatgctgggtaactaaatctaaggagagtttaaggaggaggagaacagttttggattggacacagtcaaggagtagaggcaattcagtgattaggtatcttacaaatttttatccagaaggaagaaggattaaaacaaggctagattagtccttggaaaagtgtgataccctaccttgtcttaacctgaattgactctctcttagctgagggagacagacaaactccattttggctccttcacttgccgctccttacccatcccacttcctcaaggatttaacttgtgcaagctgactcccagcacatcaaagaatgcaattaactgataagatactgtggcaagcgatagctgcagtttccaggaattcacccggttgatagtaccctaagcccctgcatttttgtccggttgatggtacccaaagcccccacatctatcaccttgtgatggatttaaagcccctgcacctggaactatttgttttcctgtaaccatttgtctttttaacttttttgcctgttttacttctgtaagattgcctcagctaggctccccctcccctttctaaaccaaagtataaaagaaaatctagccccttcttcggggccgagagaattttaagcactagccatctctcagttgccggctaataaaggactcctgaattcgtctcagagtgtggcgtttctctataattcgctcggttacaaaaaaagaagcaaaatccactcatttattagtcagaattggaagatgttgagtcctatctgcggtaccagagtggctttgtctgtatcttgatccaactacatggtggtcttgtctgatctttgtttatattctgtgatcactgtttttgttcagttagaaacattaggtctagctgtcagctgaacagtttttcattttcttacctgtaagcatttgtcctcccacatgtaggatccccccatctcttagtgtttctggccctaactggttgagtgtgtcacttctacttggccaaagcgaggacagcagatctttgtgatcatctactccaatttcccgcctcaggcagaaaccccttagcaacatctcttctagggtagggggctcactgccacccaaggcagctcctcccatctttacacatccattgtcaaacctgtcaggcctctgagcccaagctaagccatcataaccccgtgaccttcacatacacatccagatggcctgttcctgccttaactgatgacattccaccacgaaagaagtgaaaatgccctgttcctgccttaactgatgacattaccttgtgaaattccttctcctggctcatcctggctcaaaagctcccccactgagcaccttgtgacccccgcccctgaccatcagagaacaaccctctttgactgtaactttcctttacctacccaaatcctataaaacggccccacccctatctcccttcgctgactctcttttcggactcagcccgcctgcacccaggtgaaataaacagccctgttgctcacacaaagcctgtttggtggtctcttcacacggacgcgagtaaaaaaacctaggttatttccccccatatgttgttgaaaagataacacatgtacttggttataacatactgcataaaggagcacacggtgaaaatgaagtgtccttcccacccttcccccacccccatctcccagatctcctttcagagttcctacaggaatatgcatatgccagcattatggcacttttttttttttttttttttttgagacagagtctcgctctgtcgcccaggctggagtgcagtggcacaatcttggctcactgcaacgtccgcctcctgagttcaagcgattctcctgcctcagcctcctgagtagctaggattacaggtgcccaccaccatgcctggctaatttttttttgtatttatagtagagacagggtttcaccatgttggccaggctcgtcttgaactcctgacctcaggtgatccacccgccgcttttttttcacttaacttattagttcattcgataaatatttaccatgctattactatgtgtcaggcactgttgccagtgataagaaaatagtagagaacaaaacaaagtgcccacccttaaaagaccttatgctgtagggaaaaaagacaagcagcaaacacacacgtatataatataacactcagacactgacaagagctgtgaaaaaagagaaaggagaatacagagttggtgggggtccattattttcttttcttttatttatttatttttttttttttgagacagggtctcactctgtcacccaggctggagtgcagtggcatgatctcacctcgctgcaacctcagcctcttgggttgaagcaatactcatgcttcagcctccccagtagctggaattacaggcacataccaccatgcctggccaatttttgtatttttagtagagacagggtttcgccatgttagccaggctggtcttgaacacctgacctcaagtgatccgcgcacctaggcctcccaaagtgctgggattacaggaacgagccactgcgcccggccctactattttcaagagtagtctgggcaggtcttttagagggcttgacactggagcacagacatgagggaaccgaggaagcaagccataaagatacctggaggaagagcaggagaaaatgccctgagatgaaagcatgctttaaggcaggaaaacagagtctggagtcggggaacaaaaggctgattcacacttcagctatgacaggaaatatcctctccatagggtgtaggccaagtaaatgactttgtaactttacttcatccttttcatttacatagggcgtgtcccaagtagagggtatttaaactcccaaaaattctgtaacaggggcccttgagctcctatgcttgggccccctcccacactgcggagtgaattggtgagatggagtcttgctctgtggcccgggctggagtacactggctcaaactcggctcactgcaacctccacctcccaggttcaagcaattctcctgcctcagcctcctgagtagctaggattacaggtgtgcaccaccatgcccagccactttttgtatttttagtggagacggggtttcaccatgttggccaggctggtctcgaactcctgacctcgtgatccgcgcgcctcggcctcccaaagtgctgggattacaggcgtgaaccaccgcgcccagcccatactttcattttcaataaattccttcattccttcttgctttgtgtgttgtgtccaattctttgttcaagatgccaagaacctggacaccctccaatggtgacagctgagagggaaaatggtgagagatgaggctggacaagtattcagggggcagttcacttccagccttgttgatggtgacaacaactctacatcttattctaaatgtaatggggaaacagttgaaagcttttgagcaggtgagggacatggtcatgcttacttttttttttttaagctggagtttcaaaaaaaagccttcagccaccgcgccaatcatgtttacattttattttatttattgttttgagacggagtctcactctgtcaccaggctggagtgcagtggcgtgatctcggctcactgcaacctcggcctcccaggttcaagcaattctcctgcctcagcctcccgagtagctggactacaggcgcacgccaccacgcccagctaatttttgtatttttagtggagacatggtttcactatgttggccaggatggtcttgtactcttgacctcgtgatccacgtgccttggcctcccaaagtgttgggattacaggcataagccactgcgcccggccgtgtttacctttcaaaaggatcattctggctgctggttggaataaagactggagcagggatgggttagggttgagggttatagtagaagcaatggcgggactagttcggagactgttgccgtatacatagctgaaactgcctttgcaaaattatgacggagacagtgaaaaagatctaacttcatcttcgttctaacctttaacctgtccttgttccttcctgggtgtaggctgaactaactttgggaggaacttagtttatagtttaaaacaaagatgataacagccccttcccaaaacaaaccttcctcttgcctgggtactagactgcctttgtaggactaacaaattagccacaagattagaaattatggcttaggagtcatgcagctggaggctacaagattctgaccctccctgaacttctgctaagatcagcgcttgagatattttccagaccctgaacttgatggatcagctggcaccacacagattgataaagtggctcatctgatcttgtggcccgcacccaggaactcagtgcaagaggacagcttcagcttcccatgatttcatctcctacctgaccaatcagcactccttgctcactggcttccccccacccaccaagttaaccttaaaaactctgatccccagcctggagcggtggctcatgcctgtaatcctggtaccttgggaggctgaggcgggtggatcacttgaggccaggagttctagtccagcctggccaatatggtgaaacccccgtctgtactaaaaaaaatacaaaaaattagccaggcatggtggtgcatgccttgtagtcccagctactctggagactgaggcaggagaatcacttgaactggggaggcagaggctgcagggagtggagattgtgccattgcactccagcctgggcaacagactccgtctcaaaacaaacaaacaaacaaacaaaaaactctgatccccaaatgctcagggaggctgatttgagcaataataaagctccggtctcccacacagccggctctgtgtgaattactctttctctgttgcaactcccctgtcttgataagtcagctctgtctaggtagcaggcgaggtaaaccccctggctggttacacagcttgaagacagctctgtatctaaactgtatctacgtctatatctaccttggtccctcttaattcttgctacggtaatctattttattttatggatgtatcataatttatttcctcagttccctaaggatagactttttttttcgtttgagacagagtctcgctctgtcgtccaggctggggtgcaggggcgtgatctccgctcactgcagcctctgcctctcgggtttaagcaattctcctgcctcagcctcccaagtagctgggactacaggagcgcgctgccacgtctggctaatttttgtatttttagtagagatggtgtttcaccacgttggccaggacggtcttggtctcctgacctcatgatccgcctgcctcggcctcccaaagtgctgggattacaggcgtgagccaccgtggctggcttttttttttttttttgagacagggtgtccctctgtcactcaggctggagtgcaatggcacagtctctgctgacttcaacctccgcctgtcgggctcaagggatcctcccacctcagcctcctgagtagctgggactacatacaggtgcacaccaccacacctggctaattttttaattttttgtagaagtgaggtctcactatgttgcccaggctggtcttgaactcctgggctcaagcaatctgcctgcctcagcctaccaaagtgctggactgcccaaggggttcaccttgcacgctgcctagacagagctgattaatcaagaagggggaattgcgacagagaaagtaattcacacaaagcctgctgtgcgggagcccagagttttgttattactcaaatcatcctcccgaaaactcaaggatcagagtttttaaggataatttggtgggtagggggccaatgaattgggagtgctgattgcttggctgggggatgaaattgcagagagtcgctgggcgcggtggctcatgcctgtaatcccagcactttgggaggccgaggcgggtggatcacgaggtcaggagatggagaccatcctggctaacacggtgaaacctcatctctactaaaaatacaaaaaaactagctgggcgtggtggcgggtgcctgtagtcccagctactcgggaggctgaggcaagagaatggcgtgaccccaggaggtggagcttgcagtgagccaagatcgcgccactgcactccagcctgggtgacagagcgagattccttctcaaaaaaacaaaacaaacaaacaaaaaaaccagaaattgcagagagtcaaagctgttttcttctgctgagtcagttcctggatgagggccacagaactggttggcaggtccagtggggccatctggttgttagaaatgcaaaaacctgaaaagacatctcaaaaggctgatcttaggttcacaatagcgattttacctcaagagtaattgggggccaggcacagtggcttacgtctgtgatcccagcactttgggaagctgaggcaggcagatcacttgaggtcaggagttcaagaccagcctggccaacatggcaaaaccccgtctctactaaaaatacaaaaattagctggcgtggtggcaggtccctgtaatcccagctactgtggaggctgaggcatgataattgcttgaacctgtgaggcagaggttgcaataagccaagattgtgccactgcactccagcctgggtgacagagcaagactctgtctcaaaaaaacaaaacaaaaaaatcttatgacctctagaataagaataatggtgggtactatttagaactccagcccttctcatcttggcttggtggctggtggcctgtggcctttcatttgttttacaagaacagtttagctttctggaaagggctattgtttaaatgatacactaaattccttcccaaggctagtttggcctggcttggcatggtggctcacacctacaatcccagcactttgggaggccgaggcgggaggatcacctgaccaacatggagaaaccctgtctctactaaaaatacaaaaaattagctgggcgtggtggtgcatgcctgtaatcccagctactcaggaggctgaggcaggagaatcacttgaactcaggaggcggacattgtggtgagccaagttggcgccattgcactccagcctgggcaacaagagcgaaactccgtctcaaaaaaaaaaacaaaaaacaaaaaaacaaaaaaaactggtttagcctatacccaggaatgaacaggacactttagaggttagaagcaagatggggtcagttaggtctgatatctcagttatgattttttgcaaaggtggtttcaggatgacaggtgtgagccattgcgcccagcccctgatagatatttagactggtcgcaacccttttgcttttacaaaaatgaattaatgaatatatcctttgtgctcaggtttcagcatatctgcagagttattccaagaagtgtagttgctagacacaaggaaaaataaattattcctcatattgaaattaaatctggtgatctaattctccatcaaagaaaccaatttattcactctttgccacaccaccccttcagagactataaaagagaggaatctgccacccttcccacatcagttttcttgtctttaaatattcccagtcttggcagggagtggtggctcacgcctgtaatcccaccatgctggtaggcccaggcggatggatcagctgaggtcggagttcgagaccagcctggtcaacatggcgaaacctcgtctctactaaaaatacaaaaattagccaggcgtggtggcaccttccggtaatcccagctactcgggaggctgaggcatgagaatcgctcaaacccagggggcagaggttgcagtgaaccgagattgcgccactgcactccagcctgggcgacagagtgagattctgtctcaaaacaaaaacaaaaacaaaataacaaaaacccagtctaccaagccaccacctgaggccctgtctcctcctcgcacggtccccatttgaggttacagagagataaactgaggcacaagcagcacccgcggcccaagacctccccttggcctcactgtccccctttccgtatcttccccgggccaagttccaacccggatccctccttcgcagctcagccctcgactcccacttcgtccctcctctgccccctccgcggctgcggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcaggtgagcaggagccgggcggccggttgcggccccaacgctccgggcctggcgtcgacacgtcgcagggggcgaggggctgagccgccggggatcccggggagggaggctgcggcccgatctttgtccctcagccgcgccggggacggcgcccccgacgccctttgaccccgccccgcgttcagggagagtccgttttcggctgtttattatatttgtagccattggtcgacctcattcgaaagtttcttaaaaaaaaaatcccttcttgtttgggggccagaaaataactcaaaactgtgcagaaaatttatttgtgtgtgtgactcttctggggccagagaggattgacttctttgtgcgtcagttttatcgtctgcaaaatgggaatcatggtagcacctgtctgatgacgttattacaaggtaaatttatatttaaaattcgtggaggtaagccctcaatacatgggagcttttattattactactactacaaggaggaccatcactgagcatttattgtgagccacggcccgggctgatagccagggtaaaaaagtgaacgagagacatcgtgtcctgagggaactccacagttttccggaggagacagactcgtaaacaagaattcacagtgattccggttatgattttggacatacaggggggctgtgaatgcacagagaaaacagttaacctggatttctggaggtgaggttagtgtggatgatcagggagagatgccaaaagaaggtgacttccaaaatgagacatgaaggctgtctttatgttggccagaagatgaggctggtggagtgtaccttgctgtgggtagataaagcaggtagagaaagtaggtagagaaaagccttggggagagagtgcagacttcttgggaatctgcaaggatttcaggctagctggagagcagattatgagagttggagggggtctggctagatggtgtttgagagacaagcaggtgctcctcctgaaagactgtaagtgtggaggagtttgggctttgtgttgggggcagtgggaagccatcaaagggttttaagccggaggtgtgtgtctttgatcagaggtatagtttcagaaagatcagttttttgtgtttctctcttggtcttatcattcctcccatctgtttttcactttgcaggcattcatttgtggtgattcatatatatgtgtgtgtgtgacagtgtgtgcgtgtatgtatttattgttgagatgaggtctcactatgttgcccaggctggtctcagattcctgggctcaagtgatcctcctgtctcagcctcccaagcagctgggactgcaggtgcacaccactgcacctggctaattcaaaaaatatttaatgagcatcttcttctatgtgcaaggcactgtgtaggtagtaaggaagcaggtccctgccctcaaggagatcacagattggtggagaaaatattcatcaaacaagtgattataattgtgatgagaattgtgaaagggggcgcatgttaagatcaatctagcatagtttggagattcaggtagagttttgataaaatgtatggagggtgtagtctgagttagctatcgtggggatgttccaaacattttcaaaagtacattcatggagccaaaagcagtccactacaactggaacttaaagatcaatattgaaagagatccatccagagaggttgacaaaaaaaaaaaggctgagattattcagggctactgcattgcatactcttggaagaatgagccatgcacttagtctacactaaaagaaatggctagagaaacaggaacaggagagaaaccagcaaagtatagtaatgaaggccaaagggagaggttggttggcctttgtagatgttgctgagatgtcgagtaatacaagttaaaaattaaaatgtgtccttttgggtaaataaatatggaggtcggttgggacctcattgagcagatttggtgaaatggttggggcggaatctataatatcagcagctttcaaaggttcaatataatatatcagtgggatgagttaagagtgggatgtgagaaagacaaagtgtaggcagctcagagaagtttggctgcgaagggaggtagagagaaggctgaggagcgattggggaataggtgaagtttttttgagcatgagagagattaaatgctgttggcaaagagccagtggagagagagaaaggctgagaagacacaggatatgaaagggagaattgatagtataactttcctgagaaggtgggagtggaggagctccacagtacagatccttcaataggagtctgatgcctgttactttttggagacgtgggaagccaggttattcctgaaaggagtgcaccagtgtaatgcaacaaaaataaataaaggtataagtgtggaaggaaagtcacaattttcattgtcggcagatagcaggcatttattgaactagtattgtgttaagtacttttcatgcaccattcttttttttttttttgggacagggtatcactctgtcgcccatgctggagtgtagtggtgcaatcttggctcactgcagcctctgcctcctgtgctcaagcgatccacctgcctcagccccccaagtagctgggaatacaggtgcgagccaccacactcagctaatttttgtatttttagtagagatgaggttttgccatgttgaccaggctggtctcgaactccagacctcaagtgatccacccgcatcggcctcccaagatgctaggattacaggcatgagccactgcgcccggcctcatgcaccgttcttaatgaataatgtgatgtttacaacaaccctgtgagataggccctctaataattgcaaatttatggataaagaaactgaggtaacatgctcactcagggtcacacagtatttgaatctaggtttacctgaacccagagcttttactcttaaccactacctggatgatataaatctctacctgtgatatgattgtctgctgagaaaattcaagagaattaaactaaaaatacttagatataataaggctaagtgaacagcagttataagatagacaaaaagcaatagctttatgcaaacaaaaatagaaaatgtaattgtaggagaactgacaatagcaacatgaaaaataaatacttagaaataaacttaaaaatacatgtacccagcttagccacacagagtaagagttggctgggcatggggatgggatgacaggatgagtaaggtaaagtagttttcccatgggaacatcagagtattgatactggagaaggggtaggttaaaaaaaaaacaggtgtctatcataagacatcatgagatattgactatcatgtttttataaaattgaaaaattggcctggcacggtggcttacgcctgtaatcccagcactttgggaggccaaggcgggcagattatctgaggtgaggagtttgagactagcctggtcaacatggtgaaaccccatctctgctaaaaatacaaaaattagctgggtgtagtggtgcacgcctgtagtcccagctacttgggaaactgaggcaggagattctcttcaacctgggaggcagaggttgcagtgagctgagattgtaccattgcactccagcctgggtgacaagagcaaaactccatctcaaaaaaaaggacagttaggtgggagctatatatattagaaagatgtttacattatgtggttaggtgtaaaaagcagattacggtacagtatgttactgttttcttaaatgtatacatgtttataataaaaatgtctggaaatactagttctttttaaaaatgttaaatctttaattgtgataaaatttaccatcttaacgatttttaagtttacagttttgtagtattaagtgtattcatgctgtgcaaccaatctgcatgactttttcatcttgcaaaagtgcaaaagccaaactatacctttaataggtttagctccccatttccgcctccccaccagcccttggcagcacccattctacttttgttttctatgtgtttggttactctggatacatcgtgttagtggaatcttgcattatttgtctttctgtgacgggcttatttcactagcatagtgtcctcaaggttcatccttgttgtgtagcatgtgtcagaatttcattctttttgtaaggctgaataatattccattgcatgtttataccgcactttgtttatccattcatcgatggtcactttgagttgcttccatcttttggctattgtgaataatactgcagtgaaacataagtgtactagaaaggtaagctgtttatgagatcatggggaaacttttattctgttcctcattgccctaattttccttttttatgagcatgaattgccttcataatcagaaaaaaaatgaggaagtatcttctttaggaggctggggaaataagggtaaaaaagggcagtggcagcggaaagggaaaggagagggcagatttgagagacatttcagaaggagaatcaacaggacttgaccaacaagaggtaagggagagaggagtggaagatgaagctttcctggcctctggtgggaaggggcatcagtcctggtggggctttgactaggggaggagggaggaaataaggctggagagccacccaagcctttgtttagcagtttggacttctagaaggtggagagaaaccattgaaaggaagtgaaatgacttgatctgatttgcacatagagagatgacactggctctttccaaccattctttaaactgaaggcagatagtgccaggtatccctttgtgttgcttatacttgaacttctgttaatttccttttatttgagatgaacctttagtactgaagtacacatatctattattctaaaagcacctggaatattttaaacaatgttttagtgtgtgtttttttgttttttgtttttttgtgtgtgttttttgagacggagtctcgctctgttgtgcaggctggagtgcaatggcaccatctcagttcactgcagcctccgcctcccaggttcaagcaattctcctgcctcagcctcccaagtagctgggattacaagcacttgccattatgcccggctaatttttgtattattattattttttttgagatggagtttcactcttatcgcccaggctggagtacaatggtacgatcttggctcaccgcaactgccacctcctgggttcaagcgattctcatgcctcagcctcctgagtagctgggattacaggcacgcgccaccacgcccggctaattttgtatttttagtagagacagcattctccatgttggtcaggctggtcttgaactcccaacctcaggtgatccactcgccttggcctcccaaagtgctgtgattacaggtgtgagccactgctcctggcatttttgtatttttatagaaatggggtttcaccatgttggccaggctggtcttgactcctgacctcaagtgatctgcctgcctcggcctcccaaagtgctgggattacaggcgtgagccaccgtgccctgcctgtgttcagttttatctcaataacacagtctcctgtaaatatacttacttttttttttttttgagacagagtctcactctgtccctcaggctggagtgcagtggtgcgattttggctcactgcacccttcgcctttgaggttcaagtgattctcctgcctcagcgtcccaagtagctgggattacaggcacacaccaccacaccggctattttttttttttttttcatttttagtagagacagggtttcaccatattggccaggctggtctcaaactcctgaactcagatgatccacccatcttggcctcccaaagtgctgggattataggtgtgagccactgcacccagccatcctgtaaatatactttctgactttagtaggagaagtatgaataattgggaaaataaatgaaacaaaaataattcaaggtagagtatgtcacaattctgttaaaattttaaaatttaaaatttttcacattttactgaattctgacagcctccttttgagagaaaaaggacaatataaggtatacagtgtcatattaaggaactcttacaaaatgaaaatttggagggtccagatggattcagcccgtcacttagctccactcccacaaacctgtagtctctgtctacttccagagcattacagacagagggagctaactgttgtgctaacatttgtaaatagctctgcagtttagaagagctggatttccaaaagatgtaaatccatgatatcattttagtcctcctaacaattctgtggggtagggattatcattcccattttcaaatgagaaaattgaagatcagaggatgtgacagatccctctcagatactatatctaataagtcctggagtttgaatccaggttttattttcttcttatattttagcattttattatggaaaagtttaaacatacaaaagtagaaaagataataaaagacacctaatatactgagctttagcaattgccaacatatggtcacttttattttatctatactgcctacttccatcccaccttaaattatcataaagcaaatcctagtcatcatatttcatccatgaatactgtacttcaatatacacatctaagagagaaggattttttcctcctcctttcccccctgtagtcacagtttcattattacacctaaggaaataaacagtagtcagtcctaaatattacataatatccatttggtattcagtttcctcaacaattttataaatgtctttctaaaaaaatgtttttttcaagatggagtctcgctatgttgctcatgctgtacttgaactcctaggttcaagtgatcctcctatctcagcctcatcagtatctggaaatacagatgtgtgtcagtgtacctagctttttttttttctttctttttgacacagagcctcactcttttgcccaggctggaatgcagtggcgtgatctccactcactcactgcaacctctgcctcctgggttcaagcaattatcctgcttcagccacctgagaagctgagattacaggcacgtaccaccataccccactaatttttgtatttttagtagagacagggtttcactattttggccgggctggtctcgaactcctgacctcaggtgatctgcccgcccacctcagcctcccaaagtgttgggattactacaggcgtgagccatcatgcccggcctgcccaactttcataaatgtctttttacagttggtctgtgttcactgggatccaaacaaggtgcctgtattagacctgattgatgatctcttaaatcaagcttgtccaatccgcagcctgtgggccaaatgcagcccaggacagctttgaatgaggcccaacacaaatttgtaaactttctttctttgttttttttttttttgaacgaagttttgctcttgttgcccaggctggagcgcagtggcgtgatctcggctcactgcaaccttgcctcccatgttcaagcgattcttctgcctcagcctcctgagtagctgggattacaggcgcccaccaccacgcccggctgatttttgtatatttagtagtaacagggtttcaccatgttgaccaggctggtcttgaacttctgacctcaggtgatccacctgcctcggcctcccaaagtgctgggattacaggcatgagccaccatgcccagcctcaaatttgtaaactttcttaaaacattatgagattttttgtgtgtgtgattttttttcttcttccaatgtggcccagggaagccaaaagaatggatacccctgtttaaaatcttcttaatctatagccatttctcctcttcttttttccccctttgccatttatttgtttaaaaaagtcatatcatttgccctatacaacttctcatattctgcatttgactgattacatctatttatttatttatttacttttcttagatggagtctcgttctgttgcccaggctgctggagtgcagtggtgtgatcttggctcactgcaacgtccacctccagggttcaagctattctcctgcctcagcctcctgagtagctgggactacaggcgcatgccaccacgcctggctaattttcgtatttttagtagagatggggtttcaccatgttggccaggctggtcttgaactcctgacctccagtgatcaacctgcctcagcctcccaaagtgctgggattacaggcatgagccactgtgcctggcccagtttttccaatatttaaacaaccaacctgtgctatagcaagtttcccagtcaaggattcatttatgttcaagcatgctacttataaaataatacagtatattgatccatttataaaattatgcaatatattgattcattttagaatttcctttaaaggctttcttgggtgactaccaattaaccaaaattaattacgttatcccaatgaccaaattaatcccctggtcaaattgaactggatacatgagttatgtgaaaaaccttccaggggttttcacatgtactgatgtttttgttttgtttttttttgtttttgtttttgtttgagatggagtctcaaacaaaactccagtttcccaggctggaatgcaatggcatgatgtcgactcactgcaacctctacctcctgggttcaaagattctcctgcctcggcctcctgagtagctgggattacagctgcccaccaccatacccggctaatttttaaaaatatttttagtagagacaggatttcaccatgttggccaggctgatcttgaactcttgacctcaggtgatccacctgcctcggcctccccaagtactgggattacaggcatgagccactgcgcctggccgtactgatgtttttgattctctggttatacttgaggtagagtaaatgattctaaccagcactggaaccattaaaggaatgtagggcctcgtcagtattagttggttggagaggggaaggaagttaggaccaggcaggaatgagtgggtggagaaactgactcagccgtttggttggcttctaggcatgggaattcagcggagggagccagacctcctatgcatatgatggtagcaagagtagccctcattttattcctgccctttctaatcaggataggcttaggacatgagcagtgggatgtttagtgacatcggcaatgaaggactaggaaatacagactttgatttattttttaagtgattctccatcagctgtgtgcttttaagactagactatgggtttttttgttttgttttgtttttgagactgggtctcattctgtcacccaggctggagttactgtggtgcaaccatagttcattgccacttcaaactctgggactcaagtgatcctctcacctcagcctcttgagtagctgggactacaggtgtgtgccaccacatccagctaattttaaaattttttgtggatacgggatctctgtatgttggcctggctggtagactgtgtttttatttgaatatttgtaccaaaacttaacattctgctgcttattgattatattttactacctaagaaaataaatatgtattatttttaattggcttatataaaacataatacctgttttcttgtagcttttaagtaaaatttgaagcattagatttttaagtgtaggttctttaggttctttttttttttttttgagacggggttttgctcttgttactcaggctggagtgcaatggatcacggctcactgcagcctcgcctcccaggttcaagcgattctcctgcctcagcctcccgagtagctgggactacagaggtgtgccaccatgcccggctaatttttgcatttttagtagagacagagtttcaccatgttggtcaggctggtcttgaactcttgacctcaaatgatccacccccctcggcttcccaaagtgctgggattataggcataagccaccactcccggccaagtatagcttattttcttatttgtaatttattaaagccaaagacaccaagattgaaagcaactgaaaatgaaaatgatatttccggggaggctaataacttacggagctttcctgtggcctcagggtcattgttctctgttagccaatccttagaaattgctagaactcataggaatgcagagttgtatgatgagaagaacaagaacttgggtttcagggagatcagggtaaccttgggcaaggtctctgagtctaggttcccttatctgtaaaatgtctcatgaagtcatgtgagagttaattgttataaagcttggccactcgaaggggcttaatgaatgtgagttatcttcctttctcccagtcctgattttgcaaacctacctactccgtgtttctgctaatcaccagaatgaaacttaaaaaaaaaaagaaaaagctgatggtttaatcttgattttcagtgtcagttaagcataaaataattctattgttttcttatgtgcataaggcttaactttcattggtttttgatgatctctgcatgttatatatggtacatattaaatatagtggccatatttttttttaatttcttttataatatttttttcgagatggagtctagctctgtctcccaggctggagtgcagtggcgtaatcttggctcactgcagcctcagcctccgcctcctgggttcaagcaattctcctgcctcagcctccccagtatctgggactacaggcatgcgccacaatacccagctaatttttgtatttttagtagagacagggtttcaccacgttggccagactggtctcgaactcctgacctcaagtgataggcccacctcaccctcccaaagtgctgggattacaggcgtgagccactgtgcccagcagctatattttataaaccaaaaaattgggacttgtggtgtgataagtatagtatacttaggaaggttaggagaacagaatattttgaagaagtgcactctcagagaaatggtcgctgtgcttttatgtattcataaggaagcagtacaaagttgtggttaggaatgaggccctagagtcctttggacatgaattcacatcttggcccaggcactttctacttactgcacaatatacttaacctttctaagcttcagagcttcctcacttgtaaagtggatattatgagagttccttgtttcttgtgaggattgcatgaaataaagggctcagcacagtcttggcagatagaacttaacatgtaaatgtcagctgttatgtttattactgtaaagcctttgatacgtgcacacttatacagtaaactttttttttttttgcaaaaacctgttcaaaaagcacttctaaaataactcaatatttgcaaacttactctatagtaagttctttatcaggcctcgtacagaaagggcacagaaatattttgaagaccgcatgccctgtcttgcatgcccactgggaagacctgactgactttggccttctcaaaatatttgcataactctcagcacctactccattgcttctgagatgacctctgcaacgtgtatatgttttggctgatacagccaaacttgtcctggacagacttcaaggttcacttaatctactgtcacaggcttctttccctaagattttcttggttgtgccctccctagagtattggcttcttcctcaggctagcagcaaaatagctgcagtaggcctaggccccagatttatgtatggcacccacctaaggaatagaaagattgtcttggctgggcgcggtggcttacacccgtaaaatacctgtaatcccagcactgtgggaagccgaggcgggtggatcacctgaggtcaggaattcgagaccagcctgaccaacatggtgaaaccccgtctctactaaaaatacaaaaaattagccgtgtgtgatggtagacgcctgtagtcccagctactcgggaggctgaggcaggagaatcgcttgaacctgggaggtggaggttgcagtgagctgaggtcacaccactgcactccgacctgggcaacaagagcaaaactccgcctcaaaaaaaaaaaaaaaaaagattgttccttagagtgagaatttttctcagaagcctccagagaactaccctagaatctcattggcctggactgggtcatatgctcattcctgagccaatttttgttagtagggcaatgtgatgccctgatgggcttaggcctggttcttgaacaagccatttacaagagggatgaaattatctctagaccattcagaaacagaattgtgtttctgttaggaaaatttttttttttctatgagtaggtgaatggacgctgagtagattggtcgaagaggaattgtgttggctgctgataacagtgctttaaagaagacaggttatttttctctcaaaaaatattaagtccaaagtagatagtctgttcctggcatggcagttccacagtgccatcaggcagcctagatctttctctctttctgtttcaccatgcttatcacacagcttgcagtcaccaagtggtcgcacgtgttggctctggctctctagccaaacggtctttgaggcaggaagaagtaggaaaggggagggcagaggacaccctttaaagtaccctaagtcccaaccaccatgttcagtttacatctcattgtccattcttacttgtgaagaaggctggtaaatgcagtttcttagctgtacacattgccattccccaaaacagggattctgcagctgtggaagaatgagaaatagatacaagcctggaagtgggcagtgcccaccacaggaggcggccaacaatgtcagctataccctgtatttggagaaaattgcagtttttacattgactttcctctttcttttcttttcttttctttctttctttccttccttctttcttttttttttttttttttttttttttttgagatggaatcttgctctgtggcctgagctggagtacggtggcacaatcttggttcactacaacctccacctcctgggttcaagcaattcccctgcctcagcttctggagtagctaggattacaggcgtgccccaccatgcccagctaatttttgtatttttagtagagacagggttttgccatgttggccaggccagtctcgaactcctgacctcaggtgatccacccaccttggcctcccaaagtgctggggttacaggtgtgagccactgcgcctgcaatgcccggcctgcattataaatatttgttcataatgtgttgctaacagtgacaatcaataagaatcaactgggtttgttccccagcctgtttagttttattattgtgattacaaaataattaaatattatgttaaccaatgaaatgtaaagggaaaaaggaaaaaagatactgcttttatgaaaaataagttgaatgtgcttacctgataaaggcaaatggctaagaaaaaatatttttgtcaaattaggggtggaagagacctctgaaaagattgaagaaaaaaattataaaaatatggagattctgacagatagggtaactctcacctgtaatcctagcactgggaggctgaggcaggaagattacttgaggccaggagtttgagaccaatctgggcaacagtgagaccccgtctctacaaaaagaaaattagccagatgtggtggtgtgtccctgtagtcctagctacttgggaggctgaagtgggaggatcacttaagcccaggagtttgaagttacagtgaactatcatcacgccactgtacttactccagcctgggacacagagtaagaccctgtctccaaaacatatatatacatatatgtttctgccttcagaacacttcacaagtatcattccagtaaaaactgaaaatcatagatgtacatcatgagtgtagttcatgcagaaactttaattgcttgaacttactctcaagaaaaggccttcactgggcacagtggctcatgtctataatcccagcactttgggaggctgaggcaggtggattacttgagtccaggagttcgagacacaagcctgggaaatacagcaaaaccctgtctctacaaaaaatacaaaaattagcaggttgtggtggtgcatgcctgtactcccaactactcggaggctgaggtgggagaatcacctgagcccagggaggttgaggctgcagtgagccatgatcatgccattgcagtccagcatgggtgacagggagagaccctgtctcagagaagagaaggagaggagagaggagaggagaggctttcatcccttagccagtatttggaaaataaacatgcatttttaatgattcctctctttaactgtattttttaaaaaatgagttataccattattagttctgattccatcaaggagagaacttctactttgtttcttaagttgttatgtatgggttactgtgtatcaattgaaatgaatatcaccaggccttattgttggtcattataaattgtgccctggtgaacttctttccagagacatcttctctagtatattttttgtttttttgagttcttttttttttgagacagagtcttactttgttgcttatgctggagtgcaatggtacaatcttggatcactgtagcctctaccttcccagttcaggcgattctcctgcctcagccccccgggtagctgggactacaggcatgcaccaccactcccggctaatttttgtatttttagtagaaacggggtttcaccatgttgaccaggttggtctcgagctcctgacctcaggtaattccacccgtctcagcgtcccaaagtgctgggattacagatatgagccactgcacccaggcccctcactgattttaaataatgtgaagtttggaatgtctcagggagttcaatgtaatggaatttgtcctgatgttatttctttttccaaatcacatagcacttcaaacttttctttttataacatttctcataaatagtcctcctccataattacctttgtgtttattttgtgtctgctactaaactcttagcttgttgaggacaggagtccttccttggacctctgtacatcctaacatacaatgggtgctcaatttatgttcatggaatgagagaatgaatcaatgtcactgtcttctattattgcatagacatcttcagtaacacttcctttgaattcattgtcagtggagctagtcttgtagccttttcaatagcttacattccgtgttggagcaaaaaatgttaaatgtttataaggtaatttcaaatataagcaaaagtagagagaatggtataaagaaacctccattatctataatcaagcttcaacaattaccagcattttagagcaaattttgatttaggataagggtagagagaatatgatgacatcaggatgctgattttgattttgtggggagagaagcaggccatgtgtggtgagcagggtagagaaagaggaggctggtggcccaaatacaaacctgcctcataggagttgtcttgaggatcacttgagttgacataggaaagtgggaagaacaatgcctcacacatggtgagtacagcctaagtgctcccaccaccattactatcactcctgcgtagtttgtgggagctgaatgtgggagctgtggcacttactaacttggtgactttggacaccgacctttctgagctgcagtttcttcgtcggaaaaaatgggaatagtaataacatcttaaacatagcattggcggggcgcggttgctcattcctgtaatcccagcagtttgggaggccaaggtgggcggatcatttcaattcaggaatttgagaccagcctaaccaacatggtgttggttttaatggagaaccctgttctccattaaaaataggctgggcatggtggctcatgacttgtaattccagcactttgagaggctgaggcaggcggatcactggagatcaggagttcgagatcagcctggccaacatggtgaaacctcgtctctactaaaaatacaaaaaattagccgggtgtggtgttgtgcacctgtaatcccagctactcaggatgctggggcaggagaattacttgaacttgggaggtggaggttgcagtgagccgagatcgcacaactgcactccagcctggatgatagagcaagactgtctagaaaaacaaaaaaacccaaaaaaggtagcatcttatcccacacaggcagtggaataatatatgtaaatatgttctgggttaattaacattaatcacaattttccagagtggttttctagtctggagggagggaccatgtttctggaggttttttcgggagtcaagccaattccttctgtgtattctcattctgagacttcataatattcgtggcagagtcatttgtcagcctagcaaataaacattacaggacaataggctttgtttccgtttgcaaaatgttttttaaataatgaaaacaattttactttatgtagcttgtccatatatgcactgaaaatgaaatacttatcaaccaagttgataaagggataaaaatagttttcctaaggaaaactatttgctggggatttgtgttggacaagttttgtagcagtctgtttccccgtctttgaaatataaacagcatctttatttgtctagattttgcttataacaatttgctcaactcctaattaaagatagctctgtcatccacacatcacttagctactttcctaaagccagaatttctttagaaaatcagttttcttttaagacttcaaaacactttgccttctccttagtactataaagaattctaattatgtaggacattcatccagccactcctcccaccacacacacacacacacacacacacacacacacacacacacacacacacatatatctgtctgagataataattagatactgtgggaagagaaatgaaatatccctgatggttttaataattttctgcagtgtttgtttggacaagaaaatcagctgtcacatcccctgggtatgagagttatataaacccagatcagaaagtcaatgctgcagacttaaattctcaggaagttttaaaacttttaaaactaccacttgccttttggatttgactttttaaaagtttgatttttgctttttcagatactaaacttttggcattcttagtatttgtgatttatagcatcttgtacttttatagacttacttattcaaacaaactaaacccccactctatgcccagataacaaaaaaacacgtacaagatacagttttatctcaaaatgagcaatatcctgaagctatcatttggtcccagtgacatatgaactgttcgtttttttccccatatactgttctgtgtaaatgttctattacacagtctttttttctggattatttttctggagatttcgttatactttgttgatgtttcttttcaaaagctcccgcacaaatcatctccagtagtcatccagccagtgttgtactagaagatgtgttacttctaatttaaacttccatttaaggcttgacgctgtggctcacacctataatcgcagcactttgggaggccaaggcaggaggatcacttgagcccaggagttcaagaccagcctgggcaacaaagtaaaaccccatctctacgaaaaatggaaaaaaatagctgacatggtatcacatgcttgtagtctcagctacttgggaggctgaggtgcgaagatggcttgagcccgggaggtagaagctgcagtgagctgtgtttgccccactgcaccccagcctgggtaacagcatgagatcttttctcaaaagaaaacaaacttccatttgagaaagtgacagaaaagttttggatttttgtaattataggaattctttacttttctttgataatattatatctctttcagtgaaaagggagttaggaagagatctaaatgtactctttgatcttccttgttaatcatttaaaaatggaattcggagctaattttaacttctgaaggacctgggggaattttatctagcacctgaggtataccttagttttttatgtattgaatctttaggaccagttttattctttcatttaaatatgtagtgagcatctagtatgtgcttaccattgtgctgtgtgtttatatatattatctcatttaattctcacacaagcgttgttagatacataaaaggggacttcaaaaaattcatggaaaaaattgaattaaaagataaaaatgaaaaatataaactttatttctcaatataaactccatcaagttcaaggcaatattgtagtgatgataccggccatttagcccgtccctaaagaactgagggttctggaaatttagccatattaatgcagtcttttttacattattaactgaaaaaaaaaatggattccctttaaagatttcttaagattaggaaacaaaaagaagtcagaaagagccaaatcaggactgtaaggtggatgcataatgatttctgtgcacagtgatttcccattgaaatctcgcaaaaattgcccttgtttgataaaaggaatgagcaggaggagtgttgtcatggtggagaaggactctggtgaagctttcccaggcgtttttgtgctaaagctttggccactgtgcccagccacaactttcattttgttaagtcatctaatccttacaactgctccatgaaataggtactattattatccttatgttacagatggagaaactgaggcagagagcgggacagtaacctgcctaaggtcccagagctctagagtcagtggtcttaacctctattatgacctctcacttaatgagggccagatttcccctctagctttttattatgaaaaatttcaaatgtggaaaaaaattaacaagagtacaatgagcacctgtatcaaaaacctagcccaaacaattgttaacattttgctgcatatagtttatctgcatgtgtgtatttcaattttttgctgaactatttgaaaatatattatggacattataattcactccttaaatacaaaacaaagcaacattttcctgttttttttttgagacggagtcttgctctgtcgcccaggctggagtgcagtgatgctcactgcaagcttcgcctcccgggttcacaccactctcctgcctcagcctccccagcagctgggactacaggcacacgccgccacgcctggctaatttttttgtatttttagtagagacggggtttcaccgtgttagccaggatagtcttgatctcctgaccttgtgatctgcccacctcggcctcccaaagtgctgggattacaggcgtgagccaccgcgcccggcccaacattttccttttacttggtaaatgcattcttggaaaatacattgcctctaaaatcatgcaaaagtactttgctacagacaaaaaggagtggagttctaggttcagataactgtaaagagctttacatgagtatcttgatatttaaaaatcaagcagagtaaagggacaatttttgtttctataagacagcccctcaatttgctggatgtttaacatcttggtctctacctactaaatgcccatttgaatgaggagacaattgactgttgtgtcaaccaaaaaatgcctcccatcccctccgtttccagaaagtcctctagccagctgtgcctgttgagtgtcattgacttgactggtcttctgctgaaggagctataggttaaattaaaataaaatgtgctgtcacagaatccttatcatcatgattcagagttgaggtaataaaggtggtagaacttatctgtaattctcctttagttctacaaccacatatgctctagatttgtaaacaaatattcatttattctgttgtattctaccaccaccactttgttccacaaaaggttatacagcagatttttatttatttaaccattaagagtgtctccccgtgtattggaatcggctaggaaatattcgtaattgctacacttttctatataaaaagggacttgaagcagactcagggccaacacaatgtagaatctgtttcttctagctttatttctccctgtgctgctagaggtaccaaagggtttgtctcaactgttactacccctgacatattccattgatctctttacttttctctgttgtctgtcagtctgtttgtcagacttatctcaaatgccacgttgtttgcgcgtatttctcaaagccatccatcaggatacaatctaaatcatcacagcacattctgtcttgtgacactaagcacagactgcctgtgttacatttgattgtgtgtttcccttttcttccacatatgtttcagtagtaatttcctgggcaacttatgtgtggcgggccttgtttgggatcttggaaatagagagatgaagctctcctacatagtctcatttacttccaattttgctttcttgataattggagtagccttttctagcttgtatcccctgcagtacctgatgcattgccttgctcagggtaattcatatatatttctgaattcagtttggaatgaaaggagacaagcaggcacttttgaatcaaatctggtgctgccactatgcaactgtatataaatctaacccaacccctgtgcgccaggttccttatctgtaaaacatggataataacaaccatcttacaggattgttgtaaagtttaaagatgaattgtatgaagcctagcagagttattggcacgtagtaggtgctcatgaagtagttgttattgtaagggaggttcagtcattcctttaggtcacttgagtgggcagtggaagcatttaggatcttaattgtctttagggaaatgcttacttagtctgggggcttctccgagaagcaggctctggggaaggtctggctcattgctgattaactgttccctttttagagtcaatgatctgagtctgtgttttggaaccacttatataatgtataccacctgttatttgtgtatttttagaagtgggagtcgggtaatcctagtcctgtcagtaaaagagcaaactgtttaccagaagcagagcttttttcttaacactgactcacactgactcatctttctcatttttcttcccaccgcctcataacaaccttgcaagagagagaatttttagggaatcagttgacttacttttttgtgattttccaaagttgaaagcttgaaggtatcaggtcattaattccatcccaggaaaggctaaagtttatgctgcctcggagtgccagtatgaccaacgccatgtagtgaatatctcacataaacccttgtctagacaaaccacttctgttggctgagaggttagacaagtgcctgaagtgtacatgttaagagtaaacacattttgctctttgaaaatggttgccttaagttgaacctggaaagtttgctcttctgagataggaaacccaagcagtattagagtcagagctgtggtagcttcacagatggatttcagataacagagaggccagacagcacattagatcagcaaaatggtgaaggaagctttatagatcagaatgactgatatctttgtgccttcatttaacattcattaaatgaacatttactgatcatctgtgatatacttggtgctagggttatgacagtgactaataaaaacatagtgcctgctgtcatggaccttatactctaatgctcgtttatagtaaatgctaagggaacagagagatgccttggcctgcatatgtgaacatgttcctgtgcacacgggtgaggggaggaaggaaggctccttggaggaaaaggcacccaagctgagtctggtggggtgagtaggcattaactaggagaaaagggttagttaggggaatgtggggttggctgaagagtattacatgctgaaatgagctatgagtcttggggtcgagagaagagcttgcccttggagaagctgaaaaaagtgaccaaaggacagtgagagggaagtttggcacaaaataaattcagagaagctaacagtgacagcagagcattgtagaccagtttattaatttaaaaaaaaatttttttttttttgagacagaatcttgctctgtcgcccaggctggagtgctgtgatatgatctcaatctcagttcactgcaacctctgcctcgcaggctcaagcaattctcgtgcctcagccttcccagtacctgggattacaggcacacaccaccatgcctggctaattttttttttgtatttttagtagagacagggtttcaccatgttggtcaggctggtctcgaactccggcctcaagtgattcacccacctcagcctcccaaagtgctaggattataagtgtgagccactgtgcaaggcctaaaaaattttttaatccagataaatttaacatatagtgaaatgctcatgacaaatgcatatacctatgtaaccaacaccccattttgagtaggaacttttaacttggtagtcagagcaaggggaaggatgggtttttgagcagggtccagacttgatgctaattgctagctaagaactgggacaagggtgagggggtgagggggtggcaagtaccagtggggacagagctggaataggcagtagtttgctggtgggcaggagcttccagcttgggggcaaaaaacagattcttggttttcctaacttgtttttagcagaggacaaacctctaagtgctttgtaagatccaaagtgtctatgcagaagacaacagactgtgttttttcaaagattttctgggaagacttccaggctacctgcagtttgaagaaagtcttctgaaaagggcagggggcgtgggggcacctacagagacaggatttcccccaactcgataagatacaggaaaataatcatcttattgatttacttttgttctatagtaatgtgacattttttcttttctgagagtagggtattaaaaattgttacggttttgggttttacagatttgttgaagcttaatatcatttaagtgtcctattttaatatctgttttaatatctgtatttttgacagactgccagaaatcatttaacatgttactgtgctatttttgttgatgttgtcattattatttttgttgatgttattcttaaagaaaaaagaaaagatactatcgatagaattatcgtcagtattagaaattaagaaatgttttaatttcaattgaaaacaaacaagtaaacaaacatgaaaatgtattgagagatgtgtgtattctctacctttgttttattccttttacaaaaactataaggaatagtgcttaacagtgtactgtcaaaacactgacatctatttacaggaagttcatttctgaccagaattgtttgtttgtctctccaaagcttgccaaattctataggttttatgtaagtttataaatattcttgtaaacattggctttaaactaaatccttctaaatatccaaactaccatgtatctttctgtgtctaaattcagagataccatcctgttggctttagataagttacagagtagtttaggcccacatgatttaagctcacccacagttctttgttgatacttgaggatttcatctgaaaagcatcctgttcatactctgaaaatatttctttcatcttagtactcccactcattttgtgtgtgtatatgtgtatagattattttattgttccacatatatgtatatttattttttgtccacttgctagggaacctcattttttttaacaagaaaatacttgtgtgataaggtcataaaacccaagagttgggaggaatattagagacctactttatttattttattttattttatttttttgagacggagtctcgctgtgtcacccaggctggaatagtgcaatggcgtgatctctgctcacggcaacttctgcctcccaggttcaggcgattctcctgcctcagcctcccaagtagctgggactacaggtgcgtgccaccatgcctggctaatttttgtatttttagtagaggcagggtttcaccctgttagccaggatggtctcgatctcctgaactcatgattcacccgccttggcctcccaaagtgctgggattacaggcatgagccaccacacccagcctagagacctaatttaaagtttattgctgctttattactctgaacaactacatcatttattacctaaaataatctttttattttctgttctcatttagctgaatctctgagcttaaaaaaagtgtgtttggcttatatatcacattatcccacatatgttacaaccaaaacttaattattagccataatagtgtcttttggctaatattagtagtaagatttttgtttgtttgtttgttttttgagatggagtctggttctgtcacccaggctggaatgcagtggcgcgatctcggctcactgcaacctctgcctcctgggttcaagtgattctcctgtctcagccttctgagtagctgggattacaagcgtgtgccaccatgcctggctaatttttgtatttttagtagagacggggtttcaccatgttggccacgctggtcttgaactcctgacctcaggtgatctgccccccttgtcctctcaaagtgctgggattacaggcatgagccaccgcgcctggccaatagtagtaagttaatgaagatctgtactaaatttggattccaagtgaaacatttctttttttcttttttatttatggcagagtagagggttgatagatatttgttggctttattagttttctcaaattggtatgtaaaaataatactagatatataggtttaagtctccttcataagattttctttcttctaaacctttggaatatgccatgcttttcaaaaagccccactcattatttttatgatagtggaataaaagtctccaatttgtcaagctcattattcaagccttccaggattgtttgcagttttaaaataaactgctgggggttttatgcatcttgcaatatgagtacttaattaaaattaaaaagggggccatgcatctatctattctattaaggtcgtatataaataaatgattttattgggattttcagtgtatttagagtaatctatacttaatgagagggacttgtacttttcatttctttgtactatttttcagcctttcctgaacagtaaatgttttaaaaaaaactatacccttattccttggtctctaagaactgtggtgggctgggcgcggtggctcacccctgtaatcccagcacttcgggaggcaaaggaaggtgggtcacttgacaaggtcaggagttggagaccagcctggccaacgtggtggaacctcgtctccactaaaaagacaaaaattagctggtgtggtggcgagcgcctgtagtcccagctactcgggaggttgctgcaggggaattgcgtgaacctgggaggcagaggttgctgtgagccgagatcgcaccactgcactccagctgggtgacaggtgacaggtgacaaaaaaaaaaaaaaaaaaggccaggtgcggtggcttacgcctgtaatcccaacactttgggaggctgaggtgggtggatcacaaggtcaggagatagagaccatcctggctaacacaatgaaacactgtctctactaaaaaaaaaaaaaaaaaattagccagccgtggtggcgggcacctgtagtcccagctgctcaggaggctgaggcaggagaatggcgtgaacctggcaggtggagcttgcagtgagtgaagatcacgccactgcactccagcctgggtggcagagcaagactccatctcaaaaaataaaaaataataaaaaaaaaagctgtggtggagtatatggtacaaacatgagacttggtgctcttttggattcctaaggcttttccatgtctgagaactcaggaggcagcctttgcatagcagagggactaggaacctcactatttctccaaagttgactagctttctataagataacccccataaaatcactagtcattagtaataaaactttgtctttaaatgactataatatttttaaaaaggacaatgaatatgtactctatgccatccctttccatactgtaaatgtgtttctgaaaggtatgctatttagatatacttgagtcctattctaatatacggagaggttgctttttaaattgtcctcatcattgtggtagtaatagtaatattagtagtactggtagttaacatttatggaacacttcatatattttacatacatagcttcctttaacccttataataatcctatgagttaggcattttattctctccattttgtgggtgggagaactgagacttgatatgtggactatatgattgatcgattggttgattttggtaaagttcagatatcttttgtcctgtgcttgacactctaaaatagtaagtatttgggtaacaaataattgtaagagagagaaaatcatcttatcttttggactattcccttctattccattcctactgccaacactccagtccaacctcacatttctttttctttctttttttcttttttctttctttctttctttctttctttctttctttctttctcattctttctttttcattctttctttttttctttctccttccttccttcctctctctctttctttctttctctttttctctctcttctctttctttcttcccttctttcccttccttcccttccttcctttcttttcattttctttctttctttcttacagggtcttgctctgttgcccaggctggagtgcagtggcatgatgacagctcactgcagcctccacctccacagctcaagtgatgctcctgcctcagtctcccaagtagctgggactataaatgcgtgccactgtgcccagctaataaagctccttctgctgaagttatgcctaaacccttctttgcacatgtcattccttatcacttatcacctaaagaatgacagggggctttggctttgaatggccctcagtatgtataagcacctaaagatttcagtttatctcagcttcagagcagtccatctcatctgcctgtttttcttcttaaaataaacttttaaaaaataattaaagtttttaaaaggtgcagaatatttaagtaagatttcttctcccctttcccctaaatctccattctcatttcgtagaagtaaaccattcttaacaatttcctggataattcttccagaaattatgcatgtccaaacataaatataaaatctattggttgcttaaaaaatctataaatgagatcatattatacaaactattctactgctattgttcacatagatacattttattcttttaaatgacttcatggttgtatcacttacaaaccttttggctttgagtaacagaagcagggaatgtacagaaggggtgtcagacaaggcttccaaattatcagaaccaaggcaggccagggaatcatcatcctgttttagctgaagcagccaggccagtatgttgccatcactgcccttggacactgtcaggaataaattccaactgttcctttgtcatagtgtcattttttaaggttcagagtcccagtgagactatgcacaatggggaagtacccccaaatagaaagaagtgactggatgttggaaaacttaaaaaatgatacatttccattacattggtattctattgtataaacatgccataatttatgtattaataactagccacttcttggtgaatattcagattgtcatattcaattttttactagcaaaaaccactgctgcaaagaaaattatttatgtctttgtgcatttttgtaagtatatctgtgagattaatttcaagaagactgtgctggatcagagagtatgtatatttaacattttgatgtagcgccgggcatggtggctcatgcctgtaattccaaaactgagaggctgaggtgggcggatcacttgagctcatgagttccagaccagcctgggcaacatttttttcatgggcaaaacccggagaagaaaatatgaaaaaaatacaaaaaaaaaaagaaagaaggaaagaaaaaagaaaattagctgggcatggtgttgcacacctgtagttccagctactcaggaggctgaggtgggaggatggtttgagctggggaggcggaggttgcagtgaccagagattgtgccactgcacaggagcctaggtgatagagccagaccttgtctctaaataaataaataaataaataaataaataaataccattgtgatgtatattgtaattcatgcttagaagctttcactggtttacactcccatctacaaagtgaactggcttttaacttacaagatacaaagttatttatggccatatattcagcaaaagccacaaagtgtcacaccaggtgaaaagggaagtccaagtttctgaggtatagagtttcagtatttatcaggtaagcatagctaccaaagccatttttgttctggaagcatttgctgatcccgagaaagcattttttaggttaagctgtatttttggtgtcttcatatatgaggacagaattcttagcttgttgtccgtcaaggatggggaatcagataaaccacttttttagtttgaatggaacccctaagggcataagagggaacttgaactaagccaaccctcacaatagccttgccaccaagcttctaggtgtagggaatgtagaccaagatctttcatcattatggttctcaagtaataatgccatcaggcagctggcagaagcaaatgcaaattttctctcgaggaagatgttatcatcccggacatcaaaatagtcctctaaataattttttatgtaatcactagcacatgggattaaaaccaggttcacaaagaaataagataccatgaaaagaattagcaaaagccatatacaacaaaagtatcaaagccatgagatactggaatttcagatgcagaatgtaaaacactgtatttactatgcaaaaagaaatagaagccaagataaaaacgtcacaatgggccgggtgtgatggctcacgcctgtaatcccagccctttgggaggcctaggcaggtggatcaccaggtcaggaattcaagaccagcctgaccaacatagtgaaaccccatctctactaaaaatacaaaaaattagctggatgtggtggcgggcgcctgtgatctcagctacttgagaggctgaggcaggagaatcgcttgaacccgggaggcagaagttgcagtgagccgagatcgcaccagtgtattccagcctgggtgacagtgcgagactccgtctcaaaaaaaaaaagtcagtaagtagacactgtcaaaagtgacagcagatttgaaaaaatccaaatagacattctagaaccaaaacatataataatcaaaaacaagaatgcagtggatgtatttaaagtagattacctagcaagagagaactagtgaactagaagatagaagaaaattctccagaataaaccttcaagagatttaaaaaatgtaaaatatagaaaagatgattagagaattaaaacgatccagtgacaagttctaatatgcatttaaaaaaatttttttttcaagttttttcttgctgcagtgtccaggctgaagtgcagtggctattcccaggtgagatcatggcacactgtggcctcaaacttctggcctcaagtgatcctcccacctcaggtaaataggtgggactgcgcccagctttaatatacatttaattagaattacaaaatgagtggagcaagaatggtgcagaagcaatatttgaagagataattgatgatcattttctagaactgcagaaagatgaatttgcagattcaaaagtgtatagccttaaagaaaagctaaaagctaaaaactgagcaagcatccatcttgtaagtcagatcacattttgtaagtcagagaaaacacagcaaaataattctgaagaagataaagagaagctaggcatggtggtgcatgcctgtagtccaagctgcttggaaggctgcaatgggaagattgcttgagttggaggccagcctgggcagcatagtgagaccccacctaccctgtctctaaaagaaagaaaataaagggaaagaaagaatgaaaagagtagaagttatgaagtataaagcaaatgtatagcagggaaaatcaatgaagccaaagtatgattcttagaaaagattaataaaaatgataatactctgattaggttgatcaagaaaaggaagacagaaataaagaaaggagcacaaataaccaaaatcaagaatgaaaaagagggggctgggcccagcctttaatcccagtactttgggggaccgaggcgggcaaatcacttgagctccggagtttgagaccagcctgggcaacatggccaaacgccatctctacaaaaattagccaggtgtggtggtgtgtgcctgtagtcccagccactcaggatgctgaggtgggaggatggcttgagtcttggagggggaggctgcagtgagcctagatcgtgccactgcactccagcctaggggacacagtgagaccctgtctcaaaaaaaaaaaaaaaaaaagagtgcttaaaaaaaaagagtgaaaaagggagatagtatactcattaacaaaataatgatactatgaatactatgaataattttaaaccaaaattttgaaaatttagatgaatggataaatttattagtaatataactattaataaaaatggagtcatctgggcatggtggctcacgcctgtaatcccaccactttgggaggccaaggcaggaggatcacctaaggtcagaagttcgagaccagtctggccaacatggcgaaaccccatctctactaaaaatacaaaaattagctgggcgtggtggcctgtgccagctgcttgggagactgaagcaggagaatcgcttgaacccaggaggcggaggttgcagtgagtggagatcgtgccattgcactccagtctggttgaaagaatgagactccatttaaaaaaaaacagaaaccaaatggaatcagcagttaaactcttcccttaaagaagactactagcccatcactaggagtctaccaagcacttaagagaaagaattaatattacacaaatgcttcctgagaatagaaagagattagcaaaacaaaaaacctgacagtgacattatgagaaaggaaaaatcataagcccttttactcaggaaaatttctacattttactatgaaaaattcccaactatatattagcagagcacaatccaatattttacttattattgtagtataacaaactaccaaagttttgtggcttagaacaactgattttttttttttccagagattctgtgggtcggaagtttggactgggcacaacaaggatggtttgtttctgtttttgtctaggttcccagctgggaagactcataggagggcttggaatcaagcccttggcttgttgatctttgtcgtgtcaatttcttgtttttcttttttctgagacaggatcttgctctcttgcccaggctagagtacagtggcataatcatagctcattgtagcctcagcctcctgggctcaagcgatcctcctaccgcagcctcctgagtggctgtgactacaggcacatgccaccacaccttgctaatttttgtatttttttgtagagatgaggtcttactgtgttgcccagactggtctaaaactcctggactcacgtgatccttccacctcagcctcccaaagtgctgggattacaggcatgagccactgcacctggctgtctgtcttaccagtttctaaaatctctttatgggttaaggaaataagctatttatattgataggaaatataatttcctctagcctgacatttgatttttattttgctgatcatgctttttgccatgcagaatatttttatacatagtcaaatttattaatatttcctttaatgacttctggattttatatcatagtacttggaaataccttctccattgtgaggtcataaaatatgccatgtgtttttccagtgcttttatggtttcatatttttacatttggatttgtggatcctccaggagctatttttggggtgaggtaaaagactacttattaacctcgcttttctcagtcagatggagagattaattttgactgtggagaagggggctctggtaaagtatcttgatcatctcttagggtatgggattgtgaggaattactctcttttcacccaaaggaattggaatgagcatctgaagtcaaaactgcctctcctctacagcaggtgggaaaaattgttttaaactgaatcctttttcactgttccttctcatttcctaagactttctgctaccgtggtatcactggcctcatgacatgttatgattttgatctcgtttttgtactattttagtgttttttttttctgatgtcatgaaaggacacagcttcattttatgtataagctctctctaaattgtgatatagtgttgagttactgtgaattctagccgttgttattattattttttttagagatggggtcttgctgtgttttccacagcgagaatcagagctcctgggctcaagcctcctgcctcagcctcttgagtatctgggactacaggtgttcccggctttagccattatttctaggatcagttttggagggctctcctttcttgttttgttgtttgatcccaagtccatctcaggcagtggtctttctgtaactttctataacactccattcatttattatattataagataggctgtgaatataggagaaaacagaccttcatgatcatgatttcacattcctatcattgttccagacatgtataaacctctcagacctttgaggcttagtctaagataagtcctttgaacaaccagtaaaaatcattaataaaaataaagaaaatcagcaattctttttcttcattaggacgtgttgaccttgatacgaatactactatgctacttgttcttggatgaatgataccaactttgacctgggcgcttatgaaaatattttaaagcatcacttaaaaattacctttctcaccattctaactaaagcaataggttttgtgtgttagtgggtttttttctaatgtctacttatgttcatttattaagcgccttctgtttgtcaggccttctgctagtgctgggactatagagttgaataaaatataaaattttccatctactaagggagatagaatataacaagtagttataatgtacagtgctgtgaactataatagaagtgttattgggggcatgtattggtcaggattcttagtagcaaacaacaaaattcactgtagttggcataagcagaaaggtagttttaacatctgtgcttggatgttacacagatgaaagtgaagcaatcacagacaatatttccatgagaaatggtcaaccccactaagggggactcttctagagaaaacaccactgctgcctttaccagcactggtgacatcagatactggacatcagaaactgtcccataacagtcctagaacatgggcttataattttctttacgttttctagtgcagttagatgcagttagcccattcataatctttatatccttcatgcccttcattggtctatagcaactactactgggtttgaaatagccctgactttaatatggactttacctcaggcaatcataggtgattattttattatttatttagagacagagtattgctctgtcgcccaggctggagtgcagtggcacgatctcggctcactacaacctccgcctcccgggttcaagcaattctccctcctcagcctctcgcgtagctgggattataggcacccgccttcatgctcggctaatttttgtatttttgtagagatggggtttcaccatgttggctaggctggtctcgaactcctgacctcaggtgatctgcccaccttggcctcccaaagcactgggattacaggcgtgagccaccacacccagccaataggtgattattttaaaactcttacaacattgcatgccactaactacccgcatctcattctctaagacagagattgggaaactatggcctgcaggcaaaatccagcctgccacttgtttttgtaaataattagttttattggaatacagctatgttcattttgtttacacattgtgtgtggctgcttttgcactatagtggcagagttgagtagttaccacagagaccacaaagcctgaagtacttactgtctatccacttacagaaaaagcagaaaaagtttactagccgctgttgtaatgcttattaaattctctctgccttttaagtccagcaggtgaggtaaatcagtttctttcaaactttttgactttgaaaataagatgcacaatttatattatgactcatgcatgcatatcatatattatatgtaaatgaaacattttcttcttttcattctattctataccgtttcatgttttgaaaagtatgctagtcccagctgggcatggtggctcatgcctgtaattccagcactttgggaggccgaggcaggcagatcacttaaggccaggggttcgagaccagcctggccaacatggcgaaatcccgtctctactaaaaatacaaaaattagctggatgtggtggtgcacacttgtaatcccagctactcgggaggctttggcaggagaattgcttgaacccagaaggtagaggttacagtgagccaagattgtactactgtacttcagcctgggtgacagaccaagactgtctctaaataaataaataaaaataaaaatatgctagtcccagtctactaaattgatttcatgttccacaaatcagttgtaacccataggtacatgaataggcatgttccattcatgaattatccaagatctgtttcatttccttaggagttttgtctgcattcccttctggtttccattactcaatctgtcaggattctcaggtgctactaacaataagtgtctgctccagctggtttaagcagaaaagcatttcttaaaaaaaagtagggatcttacagaatcttatagagggccagataacagatcctagtgctacctagatggcagttaagcagcaaatgaaatgcaggctggggaaagccatctaactacaccatgagacttccctagagaaaaccctattcctgccattgcgcagcacctgtgaccctagggtctggctaccagatatcctgcaaggtcagccccgtaagaactcagtctctgtgattgtctcaccaaagctccttgaaggagggctctcctggctcaggagctcagaggctgctcagggcatttctaccttttggaatcctgcttcattttcatctcgctgttctaaaactcctaatttttcttctcctattttattttccttttcttcagctatctactttgctcctttccttctccttttcctttatcctcatactcatcttggccattcctatcatcaggtggcgtaactcaaggctgaggtccctgaacagagcttagagctcatttcttcccactttcagtgtaccttcaacggcttttctagctactcctcattgaggttgtccagcttgtgtttcttgtgcaccttccagtgccgggcacaggctgggcagcacaccttctgggccaggcccaggattaagaacaggagcagggccctagagactgagactgttcccggctgacagagtgtggcttatgtctctcttcaccatttttaatggccagacaatgtgtttgatattttgattatttctattatttcactattataaataactctgcctgtaatcccagcactttgggaggctgaggctggcagatcgcctgagcccaggtgtttgagatcagcctgggcaacatggtgaacccccgtctcacaaaaaaaatacaaaatgagctaggcatggtggcgcatgcctgtagtcccagctattcaggaagctgaagtgggaggatcacctgagtctgggaggtcgaggctgcaccatgatcatgccactgcactcgagcctgggtgacagaatgagaccctgtctgaaaataaataaataaataactctgatataaatgtctctctcatttataagtcagtgtatgcacattttgtagcacttggtatgtattttccaaaggaacttaaaaataacttttcgtattttttctttttgtagaagtaatgctatattttagtgtaaaatactattttatagaaaaaatttaaaataccaataagaaaataaaaattacccacagtgtcatcatcctgatatgctactgattaatagtttcttccatttttttctactttccgttttacagacatgagccccttctacatataggggctcaccttaacattaaagtgagacttttttttttttgagacaaagtcttactctgtcgcctgggctggggtacagtggcacaacctctgccgcctggtttcaagtgattctcctgcctcagcctcacgagtagctgagattacaggcacctgccaccgcgcctggctaatttttgtaattttagtagagacggcgtttcaccatcttggccaggctggtcttgaactcctgaccttgtgatccacctgcctcagcctcccaaattgctgggattacagtcgtgagccactgcacctggctcttatgtgactattttttttaatgtcatcagatattcttcgatagtatcatttattgtgactgtgtaatattccattctgtagatttaccaaagtttatttaaccactgcctaatagtggactttaaggattttcagttttacagttttctgaacagtgctgaagtgaacaactttaagtcaagtctttgcacacacatctatagtggtttctcttggatagattcttagatgtaagatgagtgggtcagagagcatttacattttttaattaagaaactttattttttagaccagttgtaggttcccagtgaaactgcacagcaagtacagagaggtcccatgtcccccctacatttttaaggatttcagcacatatcgtcaaattgccctttaggaatgttgtaccgttttccattttcacctacattttctcatatctctgcaacactgagaaatatcatttaaaagaaatctttgataaggcacatgtctagtagaatacctattccagtcaagctaagactaaattttctctctcctgaaatttatatttacattattcagtccattattatttattgtggttagtgatcacacagttccaccaaccttccttctttggccaatttaacaaaaattataaaactaatacatagacacaaaaataaacattcagaacagaaagatatagcgatgaaagtaaaaaaaatccccacttgctttagccaggccttctgaaagcggtttgttttttactttaatgcttttttgtaattgtggtggttacttccaaaactgtaaataaaatatacataaacatgtaatttttattttttttgttattttattttgtcattttatttatttttttttgaggtggagttttactcttgttgcccaggctgcagtgcagtggcgcgatctcggctcactgcaacctcggcctcccgagttcaagagattctcctgcttcagcctcccaagtagctgggattacaggtgtgagccttgccatatcgcacactccccgtgtaatcctgctgtccagagatatacaatttggtgtattgtatatccttttagagatttaaatgtaggctgggctcagtggctcacgcctgtaatcccagcactgtgggaggccaaggcatgaggattacttgagaccagaagtttgagaccagcctggcgacacagtgagaccctgtctccacaggaaatgaaaaaaattagccaggaatggtggtgcatgcctgtagtcctagttattccagaggctgagttgtgggagaatcacttgagactaggagtttgaggttacagcgagctatgatgatatcactgcactcctgcctgagttacagtgcaagaccctgtctcgaatgaatcaataaatatatcagtaacaacaaaacatggactgtgagccaggtactatgcatagtctcattaaatcctcatagtgtctgagatgggggcccttgtttaccaaaacgtaaacttgaaccttatggctaactggtgacttgcctaaacatttccagtatttcctatgataagttgtatgcaataaataagatgtatctaattatgtgttcttgtgtgatcatctccatttaatacatttccacaactaggatggtttggtttaaaaagtgtgcacatttaaactatttaaacttttgtatcatcctgagggaggtagtttagagtgtggactttgtcgtcatacataccagtatttagattctgactgccacttactggccactcactaaaatgaaactgtacatcagtttacctatctctaaaatggaaggataacagaagcctcatatggctgtgaagattaaatgagatgctgctgcaatgtccctggctagtgtgcagcacctaggaagaatggtgtccaagacagaccaggcccctcatctcatagaactgatattttaatgtgggacaggaggaggcagcagtgaaaggcagtaaagaaatgaatgaacaacaaaaaaaagtggtgctgtatggacgcttaacagaaagtgacatgataggtagatgggtggttattttaggttgggtggcttgggaaagtttttctgaagaagtgacatctcagctaaggtctcagtgataaggatagttttataattcaaaaattcctagaaataaaaacatgggatcaaacattacatgcattaggccaggcaccgtggctcacgcctgtaattccagcactttgggaggccgaggcgagtggatcacttgaagccaggagttcgagaccagcctggccaacatggtgaaaccccgtctatactaaaaatacaaaaattaaccggatgtggtggtgcaggcctgtaatcccagctacttgggaggctgaggcaggagaattgcttaaacccaggaggcggaggttgcagtgagctgagatcgtgctctcactacagcctatgcgatagagagactcaaataataataataataataataataatgacaaaatgacctgaaaaaatttttaaataatttgcattctatgtatagacatgcctctttttctttaccattaccagaacttttttcctaatgtaaaaaaaaagtggggttgttcaaagattgtcttagggaccttctaatgagctttactggcagagggaaaagataagaaaatgtgtaagtcccttttaggaatctcttctatttcctctccctgtgttaattgtctaccatcatccattatactataaaccgttgtcttcactttactggcctttttctttacaccacatcctgcctacattgtaggactggaagctgccaacatgcatgttaactaacaagcactttttcgtctttagaattaggcagtgcctgggtcaggggagatgcaagattcagaacagcaatgcttttgctataaaaacaaggcagcttttagggtagactggtttttccaaacaaattcattgttaaggctgtaacacgttctgtgagttaaaactgtgcagaaggctctgcacatatgtttgttacagttgagcctttttcctgtatggcatgcaatgggggcaatgggcattggtgaacactgtacactaccattgcttccacaggtaataagacctcttgtttgtaacgtgtatatgattacatattgtggatctgttctgaaagcctttaatcatcgtagaaacgttctctttgtagggcttgagcaggcctcagcatctttacgacaatatacatgtttttgtttgtttgttttgagacggagtctcgctctgttgcccaggctggggtgcagtggcacaatctcagctcattacaacctctgcctcccgggttcaagcaattctcctgcctcagcctccccagtagccgggattacaggtgcccaccaccacacccggctaatttttttgtgtttttagtagacacagggtttcaccatgttggtcaggctggtctccaactcctgacctcaagtgatccacccacctcagactcccaaagtgctgggattacaggcgtgagccaccacgccaggtcaatatacgtgttaaattatagacatcactcagttactgttttgttcatgtatggggcaaatatatatttttatagaatatacatgtattataatttaatttctgattcaagccttaaagaaaatatgtagttcaaacttggaaataaatggattaaaagtcacttgctcttaaaatgtggtttctttttataatcttttaaaattcagcaacttaaataaaacatcctgagggcaacatgtgttagtgagggggactgggggtggcgtggggagggagtgtgtttgatgaaattgtccaggagcaaagcaccacttacttgaagcccagagatttgtcatccaaatatgtgcagattgctgggctataaatagtttgaactcaagtaaacagcctcttctccctaactgctgcttggccattgttcagatgccagcacagactgaggagcatctcacaccaagctcaaggctcttgtgcccaaattttgggctgcttctcttgtggggagagcttcagctaccctgacttgagatgaccaagggtcacatgttcaccctctttagttatcccacgtttggctcccacccctatgcaacctgatgtacagtttcataaacatgcctctgctctgatgagtagcgctgatctaagaagattcctggcaactattaaaaagccctggggccccatggctgttgactgaagtagatttaggaagcacagaagttcttttttcagggcagaggcacgcatggctcatttctttctttggaactaagtagagtggcactggttgtcagaactgctgcaggctgcctgtgccagcaactcatctgctctgtgccaggcaggcaggctgctgacatttcaagagtccctttgaggactccagcaacatgctgtcattagagcaactgaggacagtccatagtttattagtatatttcctttggaaaaaatgtctccccctctctctctctttaaaattcctgctttagctgcattgctgcattcatgtgcagtgactcttatgtcaaatgcctatgaggagattatgactaatttaacattttgttgttgagaggacataaggaatggtagaaggagtactagattaaggatcaggagcctggattcttgcgcaagttacgtaacttttcctagctttgatttcttcatttgtcaagtaaagatagtcatgtccctcctgtttcttggggttgatgagaaaatttatgtaaaggtactttctggactataccgaacaaatggaatgcaaaggagaagtagggtaatggaaggagcttggtgtttgagtctcacaggcctcgcccacactgtgacctcaagcaagtggctaatgtctctcagcctcaaccttttcatctgtaaaatgggaacatctatacttgccttgcaggagtgttagaaggattagaaataacatatgtaaagcactgacaaatggcaaacaatagttgaatagcaataattgttattattacacttaatgtggatatattcactctgggtgatttaggattctaaacctaaggaagtattcagtttatagatgtagagattagcaaaaggccctgctagtaactgatagtagcaactgataataatagctaactttaaaaaatccaagtaatacatgaatatgactttttaaaaagtctctgagtctagaaaggcatctgtctcctgcttacccctcaccctgaggcagccattttatttttctgcttttacttcttttggtggttacttctatttctctaaataatgttactcccatttccttttttaaatgaattttgtttttgtcagaaaggtacatgcacatagtttgccttagtctttttaaggtcaaatatcataaaagatttgtaataaaaaccatctgttccctgcccccaccctttctttacccttcctcctatcctgctcccaagggcatacacttttgatccttttaggcgtttgatctagcatttatctctctatatctaaataatatgcttatcgagatatggttttttttaactgtattacagaaattttgaaacatgtacaaaactagaaagaatagtataatgaatcctcatgtaccacccattacccggcttcaaaaatcaaaaacccatgaccagttttgtttcatctgtgctggtagccattttcccctgccactagattattttggagtaaattctagacatcattttatcagtaattacttcagcatgttttttttgtttttgtttttgtttttgtttttgtttttgcaatgtcgcctgtcacccaggctggagtgcagtggtacgatcttggctcactgctacctccacctccctggttcaagcagttctcctgtctcagcctcccaggcaggtgggactacaggcacacgccaccatgcccagctaatttttttatttttagtagagacagggtttcaccatattaggctggtctcgaactcctgacctcaggtgatctacctgccttggcctcccaaagtgttgagattacaggcgtgagctaccgtgcccagcctagcatgtacttttaagagaataaggactccttttaaaaatataaccacactatcacacataaaataattaataatcctttattattagcagtggtctccatttaactcataagttatttttttagttctagtcagatccaaacaaggacctcacattaccatactgctttttcttgactcatcagttttttgtttgtttttgagacagtctcgctctattgcccaggctggagtgcagtggcaccatctcagctcactgcaacctccacctcccaaggttcaagtagttctcctgcctcagcctcccaagtagctgggattacaggcatgcgccaccatgcctggctaatttttgtatttttatttttgagacggaggctggccgtcacccacgctggagtgcaatggcatgatctcggctcactgcaacttctgcatcctgggttcaaacgatgctcctgcctctgcctccggagtagctgagattacaggcacctgccaccacgcccagccaatttttgtatttttagtagagatggggttttgccatgttggccaggctggtctcaaactcctgtcatgcagctggttttgatcagacatcctgtcatgctttatttggccattcacaatcaataataaaagacttctttaaggggataggtctcagttcatctgtttgtcccataggcctctgccctgcctgggaagctgctgggtactggaagggtactaaggtactaagtggaagatgctttagggcacatgagcaggagcagcagttagactgagggcccttcacgtgttagcataaggaggccagtctcttactagaagccctcgatcaatcctaggcagttcattcaatttatttaaagaggcctcctgtctttggctgtggttctgcagagcttttgggccctctgtgtgctgcaggtatgggatagaggagctggctggcacaggaccttcagtggatcccttaattttttggcccttctgaatcttctcgacgcctgctgtcttcaggttcagagcctccctggggtcccacaccattccttgtctctcatttccaatggtgctttcttgtccttgtgctccaaacttcagcttctgttgtcatacctctctgaactttttctatcttccggaaattatttgaaatgaaatcccttgttctctaatgatccttccttcagcaaaaaggcccaatttgtagttcagaagacgtggtgctttttacaaaaagtatgttaatgttttaccatagactggactaagtagagtgtgtgtgtgtgtgtgtgtgtgtgtgtgtgtgtgtgtgtgtttagaaaatatttattgagtttcctattttatgccaggcactcttctaggcacttgggatagatgtattcagtgaaccaaggagacatactgttgactttgtggagcttacagtctggtggggaaacacatggaacgtgtacttataaatatgttaagggttataagaagagacataggagtaccatgagaccagtacagcagggggagctaacgtggctcagagaaaagggcgccctagggaagtgatatttaatctgaaatctgatggctgagtaggagttaaccaaaataagagggaagagcccttcaaatttgtatgtcaaagtgcagtagcaagtgagagtctgagaccaatagagagtagcaagtgagagcctcaaaccttctcctgttggagcaccaggctgtactacctcaggatagtcccttgccttctctggatctggcattcctcacccctaaaatgaggagaccacatgctcctttcagctgcaaaaatcaatgagtccaagactgtttaaagttaaggtcactgtttaagtgaaggtccatctctcccaaaacagctgtagttggaaacttatctcaagctggtgggaagtggtttgaaaaaaggcagggaggggacagtgtgatatcctgcgaacctatccagtttctagccacataatcactggggtcaggcttctcttctccttctggctctccttcagacacaccaaatcagcagtccaaaggggaccacaaagtggatcctcaggacatcgaaccctgaagaaaaagcagccacgtgtactccaaaaccaaaaaaatacgttgagcaatgtcttagtcatcttttgtgggtttgattccccatcccccaaaaatgacttaagtttctgatttcaaaacattgtgtgtatgtgtgtgtggttttttttttgagacagattatcattctgtcacccaggctggaatgctgtggcatgatctcatctcactgcaacctctgcctcccaggttcaagcaattctcctgcctcagcctcccgagtagctgggagcctcctgagtagctgggactacaggtgtgcaccaccacgcccagctaatttttttgtgttttttttagtagagacagggtttcaccatgttggccaggctggtctcgaactcctgacctcaagtgacctgctcgcctcagcctcccaaagtgctgggattacaagcgtcagccaccgtgcttgaccaagaacattgttttaagtgtaagtgtggttccttctctggggccttacaccaggattgtggtgagacgatgtattgttctcctttcttttttcctgttcttctgtattttcttatctttttacaataagcaattatgattataattggaagaaaacaaaatctacttttattcgtaaatctcaatcaatatacttctcaattaattgtctagaaaaagcatggaccttctaactgcatggcacagtgaataagtgagttggaaatggtatgacagctgaaacctgcctttgatgggtgatgagcgattgcactgtacagcagctgtgtggactagaaagtgggtagtggtggccagaatttctttattcatatactccttcaacagatatccgtcagttgctagctgatatagtttggatgtctaactatattggtggatagctgttggatgtcatgttgaaatgtgaaccccagtgttggaagtgggccctggtgggaggtgtgtgggttatgcgtacagatctctcatgaatggcgtgatcccctccctgctgtaatgagtgagttcttgttcggttagttcaagtgagaactggttattttttaattaaaaaaaattattttggccgggcatggtggctcatgcctgtaatcccagcactttgggaggccaaggtgggcggatcacgaggtcgggagatcgagaccatcctggttaacacggtgaaaccccatctctactaagcatacaaaaaaattagccgggcatggtggtgggcgcctgtagtcccagttactcgggaggctgaggcaggagaatggcgtgaacctgggaggcggagcttgcagtgagccgagattgcaccactgtactccagcctgagactccatctcaaaaaaaaaaaaaaaaaaaatgcaagggactacatgtgtgcaccaccatgcccagctaatttttgtatttttagtagagacggtgtttcaccatgttggccaggctgtcttgaactcctgacctcaggtgatctgcctgccttggcctcccaaagtgctgggattacaggcgtcagccactgtgcctggccctggttgtttaaaaagaacctggcacttctccctctcacacttgctctccatcttgccatgcaacattccggctctcctttccctctaccatgtctaaaagcttcctaaggcctcaccagaagcagatgctagtgccatgcttcttatacagtctgcagaactgtgagccaaataaacctcttttcatcataaattattcagcctcaggtattcctttatagcagtgcaaacggactaacactgcgtaacaaattaatcaatctgtgcctgtgattttctcatgtgtcaagcagggataataattatacctacctcatagagatccttatggggttaaatgaggtaatttatataaagcagttagaatacaaccaggcacggtggctcacacctgtaatcccaacactttgggaggccaaggcaggcagatcacttgagctcaggagttcaaaaccagcctgggcgtatggtgagacccccgtctctacaacataaataaataaaataaacagaatattacctggcatatggtaaatatacaataatagttttggggtttgtttatggatttccttattttaataagtatctcataatatgtacaaaatgctgctatattagacacagatcttttccttaaaaagttaggattctggcagagaaaaaagacctgcccccaactaaatatgtgtcatcagagaaaagggtatgtttcttaagagagaaacagagcatactaaggaaattcagaggaaggagagaccccttctaaactgggggtaaaaggtggaattaaacagccaaagtttccttcatcctcaaatggagctgatgctgctgtctgtgaaaaacagccaagtttcctgaagggaagccctttaagaggtggtagtgcaagggggttgtggattcaggactggcaccacatggtccctagttagagtgcaggctctgccccttgctcccgtgagcctttgagcaggttggtcggctcaccatgcatctgttgctacagctgtaagatgtgaatattaataatgtctcctgcacccgattattgtgaggatgacatgaagtggtgttcatagagtgctcagtgcacagcttggccccagcccacataagtgtgtccagtattgtcagttataagaagaaatgaatgtgccagtgttgctatggttctgtcttccgggattctgtcacagacgtagaattattccgttcacaagggaagtgatacagagtacatgttgttgaagaaaatgatgttgtttttatgaatgggctccttactattatttttgttcaagtaacaaaacatgattcaaagcacccatcttcaagagcccagcctcatttcctgacacctactcagtcttctggaataaaggctcagccaaacaatagccctgacctccagtccctccaaactgagtgttgctgctgagaacaggccttacagctctgggtgggcttttgttcattactcatcgtgacattctggagaaatacaggacccttttgacttcccgaccaatctctgactttctttcattgtcacatcaccattagggcaaaggatgatgaaatggtcagaattagacaagaagtattcaaatatttttcaatgtatagtatgtgccaggcacataacccacacaagaaccttggagagtaaggctgttattcttctcattttacactgggaaaccaaagcacagcaagaaggtctagggaccagaaggaagcccacatctctctgagctgtgaacggctgctctctgtgggttaccaggctggtgtttttttgttttgttttgttttttgttttttgttttttttttaaagacagagtctcactgtcgcccaagctggagtgcagtggtgcaatctcggctcactgcaacctccatctcctgggttcaagcaattcttctgtctcagcctcccaagtagctgggactacaggaacacgccaccacgcctgactaattttttttgtattttagtagagatggagtttcaccgtgttgcccaagctggtctcaaactcctgagctcaggcaatccacccacctcggcctcccaaagtgctaggattacaggtgtgagccaccgcgcccggccaggctggtgtggtttttattccacagcagtcctacgtcacattgtcacattgttgaaaagccttcagattgacaaactccctcctaatatagcctgttttcttggatgttttctgataagcatctgtgttttctgagaactaataaaaattcttgttaaaccacaaattaccacagcctcttccttacctatagagagccgctttcccagtaaagctccggtcctaccttcccatcaccatcaaagtggcattgaaacagatcagatctgctccttttgagggagttagttgaagcccagtcttgcttcaggccacacaggatttgggtagcaaagcaaggaaagcagcctctctgacctagtggcctgagtgtttcctttcccaggctggctgcggcaaccactttgagaaatggcattggcattggcatgtgtgtggcatgtgtgctgacctagttaggagttgaggcttcatttctaattctgtccctttcgttttgagctgtgtgaccttgggcatgtcacctaacttctctgtatatgtcttcttatccaggaaggagagattaataatgtagcctcatagcacttatctgattctcctaaggatgttatgagaatcaaatgagattatgtacaacgagagcaaacatttattcaatacttagtatgtaccaaatactttcagtttccttacatgtgttttttaattctcacaatcctaaaacagaggcactagtatcccacttgacagttaaaaaaactgaagttcagagaaattaagtcagacaggactcagatccacatctgtggctcccaaatgatgttcctaaccactatgcatgtcactcgctccccattgtacacgaaagtagagagatgttctttgtctttaccatcaagcactctccaaatgcaagaaatgatctctcgtaaccactgctgttccatgttggtccctaaggacacttatagcctgttacttgtttgtcttatcttgtagtttatgctgctgcttttcatgtccctaaggacttgttcagtgaattcttttggttttactcccagagaatctgttcatctccttcataaagggggttaaaggtgcccagctgagcctggcatcttgggcagtggcctctgacttctccagggttcttccttccctcaagcatgtagttgggtagcttgtagtaaaatgctctataatgcatttgtttataagttccccagtcactgatttttactcattgaatctcagaagtggaaagcaccaaagccagcattttgttgatagggaaactgaggtccagagagggatgtgacttgcttgaggtcattcattcagttgaaggcctgaccaagactggaacccagtttcccaggggacacaccagtgctgtttccaagccttccccgggggcacacatcacctcccctacatgaaggacaaactcatgtactgtgcccagcatgtacctaggagacctgggagaaatgaaacaacttggaaaattgggcaggaagaaagagatgggtgtggggtggggtgaagatctccaccctaactagtatattatataccaaagaaaggaattaaacacacaggaaagcagacaacccactaagaagcaaaggaatttacccaggaaccctggctcagtgagtggataggaagccttttgtcactaaagctgcagggttgaaaattgaaggaaggatattaggcaagcgtggtggcctgggatgcagttacagccccctggctcattgtccaaaggaaatggatctctcctgtggacagagaggtggaaactgagtgagtgagttgtgtggttgacatcatcaggctgagcattggattacaacaaatggggacttacttggcccgagacatgggaaacacccactaaaacctcaaagtgcttttcatttaggagacacggggaagagacagagaggagggtaaagtgagaatcctgcccgcaccacaggtctggactgctaaccttgaatcctggtttcttaaattctgcctccgcttctgactgaggaccactggattttgaggaaactttggtcttgtaagtagaactttactctcctcccctgcccaacacccccagggagaagcagagcttggaggcagagctctctggagagcttgctttccagcctgttggccacaaaatgtctatttttatataatgatatatgtgagcttgctctgaaaattatggccttgtctgaaactgcctaaggctagtcggagcctccagtctcacaaatgggctccattcagatgctgtttcatttttactcaaagaactttgacagagtattcagagctttaaaagcagctccttgctccaaatataggtgaagaaataaatcttccctaagaaattcgtgtttgtaaaaccctttctttttttctgattacaaaggtggtataataatttttaaacattctagaaagaaaagtctccgaaagtagtgaaaattccctattatcttccccctcaggaacatggttgttgtgttaaatttcagttacagatatggtcagactccatgaatttaccacatataaacccagtgctgcagcagctgtgtggaaaactccaagatggaaaggggttggaaatctttaaccttgggtttgcgatctttttattgcttccttttaaaaatttgctgtttatgcctggaatataaacaggacatgtaagcctttaggcattttatttgttggtatctgttttcagggtttgaaactaagcaagctactctgtagagagggaaagagggggcccttgctgtacccaggtcccttacttggtgggtccctgaactgaggaggattcctaggtggcttgagatggcttgcagtgtgctaacaggggaggtgtcccctcttagcaggttaagtatatttgaaaagttacagctaacgggaagatttcagcttcaacaaaaagctaccatatattagaagggtcacccaaggaaactgtcaccttgggcaagtgtttcacactctctgggtcttgtttctttatttgtacctaatgaggggacaaaactagatgatctctgtatttccaaattcagtatgaaatgaactgtccatatttcttttccctttgtattgggcccttatggctttaggagcaaaggaccctaggttttcagtttcccagagtagctaaaaacgggtgcctgtaggacagttaaaagaagacataaaacaggcaacattaagttacttctgagtttttatgggtctttttcagattaggtgttcttgaagaaagagaaagaaaaagtctcagtggtaactgtatgtgcacacgcatacactagcacatacacttggggagagaggaaagaaggaattggcattattgagtatctcttaagcactaggccctatgttatgctcaaccctttacagagcactagatggtcagtattattccctaaccccattgactgaggacaaccatctacttatatgttttcatattatcctgaactaaactgtatttacataattactggcataacttcaattccccatgtctccactagaccatctgcaccttctctgcgtgtctgtctagcccatcactatgccccactgcctagtagaaagcctggcacataggtacaaaggagacacaacttaatttaaacttaaagcccgccatcctagttcctcatttggcaagaaagagggagaagaagggggaaaatccctctatttgcccctctttcatcatttaacatagagccaccctctcctgccacaagggaaggatagccacagccagagtgcaaaaaaaaaaaaaaaaaagcaaaagacgtcagatcttgaattttgagtttccaaggtgccgggtcttgacaaattaaggtttttgctttgttttgttttgtttttgtttgtttgttttgttttctttaagggcatcagagaccctaatcctcaggaagttgtggtatttagaaactatttgtttgaattaaggtcctagttaataagagggttctcaaaggcccttggcacttctttttttttttttttgagacggagtctcactctgtctcccaggctggagtgcaatggtgcagtcttggctcactgcagcttccacctcccgtttttgttcaagggattctcctgcctcagcccctcgaatagctgggattacaggcgcctgccaccacgcccagctaatttttgtatttttagtagagatggggtctcttggcacttctaaagctgcagtcttccccagcatttcatcccatgaaggtggactgttgctgccatggacccacccatgggcatgggcagtgggaaggccagggcatcctctgcttcatcccagccccgctgggatcttgagatttggggtaatcaaaaaaggcatcctttttcctaaggtggtggtgaggaggtgatgttctggaaggaaggtacctagactttgtggtccctgccaggaagtggagagtggaaatgtggaatgcctcacactcctcaactaggtaggccttcatgtaccagatgagggtggctttcagttcttgttttgtgtgtcaaagttgctcctgttatcagtgtgtgtttgctgatctctcccacctcagtcactcccggcagtgagtttagggcatcttgggagtggaggtaggttgtggaaaagatgtgtccagagatctcatttggctttggtatcttcctgaaataaatgtcacacacagggctgggcatcttgcatatgctgacttctcttaatcttcacagcaatgatgtgaggcagagatcatctccattttacacctaagaaaggcacagagaggtgcagtggattgcccagagtctcacagctggcaggggctagagcttgagttcccaatgagaactggttgtccccgaagcccttgaatatttcaccatactgcagtgcctttttcatatcacctccctggatctcagttgctccatctgttaaatgatgacaagtgaactctagtcagaagtcagagtggtgttttgtttttaatttgaatgcctttaggcaggtgtgttctccagttcattaccatttgcgcattcccctgtgccctctagtctcctgcctggcccctggcccctgtgggaatttgcagccctgcatctggttggtgtctaccgtttctttcgatttagacaatctagagggcagtgagaaattggaaaggggtagcaggtaagagctctcgagttcagtgagaaattggaaaggaatagcaggtaagagctctagagttcagtgacaaattggaaagagatagcaggtgagagctcttgagttcagtgagaaattggaaagggacagcaggtgagagctctcgagttcagtgagaaattggaaggggatagcaggtaagagctctgctttcaccgcctcctagctgggagatcctggactgatcacctcactttatagaacctacttctctttctgtcaagtggggggtcacagtcatactgacctcaaaggggtgccatgcggatgaaatgagatagggctcataaagcacttagttagtacaaaaatacatgcttaggattagctgctctcaatttccagaaagagaatgtcagccaatgtacacaggcatctgccccctcagacataggatggcatttgcatgaggaaccagaagttatctttgaactcatcattttgaaacccctgtgatgaaccctggagctgccatgttggctcttcaaaccaagcctcagcattatttcctgtcacccagtcaagtgatgctgaacctcaaatcagccagccagtgctgaggccaaaagcagaagtgggtgctattctcttgggaccagaggaccctagcccagccacttaaggaagaagctggtaacaggtgctggctgtgacagacaagaagctgaactggcccaattaactctgccaaatgctttcacgaggggccagaagcaattcctaagtggagactgaggtggaaaatctaaagttctgggaaacaggttattaatcatgaccctaggctgagctcactacctcctggaaatccttcagaaatgtcttaggaaaacttggagtactgctccttcaaagagtggtttctttggaagttgccgtgggctcctatgctgactgattatgaattgcagattagaacacataatgtatccgctcttactggaggaagctgcatttccaaaaagaagtctctttaatgtttcaagaaattacaggctttagcttgactcttcagaactgaataatggcccttcatggcaccgaagaaagtatttggtgtattcttactatgtcccaggaacctaggtcagttactgttttagtactttatcagtgtagtctttaacattccataaatgtacattgaggacctgttagtactaagcactgaactagaggaccagggtaaagacactgcctctggtcttgtggaattctctgtgcaacaagggaagatagacagaggagtgaataattttaatggcacgtgaaaagtactgcaaaagaaatatgcacaagtgctacaaaacaccagacactggatcagcatattgtggaggtcctgatcttgcgctgggttgattccttctgctctctccctacaattcctggctctgggagctttgccagcatttgcattagggagcaactgagagctgcccctgctgaagcactcatttctggcaccttcctatcccccgtggcttcagaggggtggaaagaacacttccttacaaaatgtatgggccccacctgagagggccctgaatctgaagtccaaagttgtagtaaggaaacagagggacgggtgacttttgtagtctaaaatcaccactgattttccgttggtttgtttttataacatttattgtggattttttttttctgattgcaaaattagaatatgttcaagggaagaaaagctagatagtacagaaaaacacacttaaaataaatcatcactcagtgatttcacttctctgtttttgaataagggcctgtctcccaatccccccacccacataccgctgtatttcaagtttagctctaattttaatttctccctgggcaaagtctcatgtttgtttgcatatctcaaaggtgcttgtgttgtgggctccaatcactactatctgcaattggttagagcctgcggccatcatttatactttcctggacgtgtgtgtagattcatctactgctaagaaccctttatgtgttaggcattatgcaaggtgcggtggggaatgtcgaggtaaataagactttgaggttgctcatggccggataggaaaaaaagactcagataacatgaacacattgtgaaaatgtgccccaagatggggacagagtcctgtagaaagcctaagagattggaggagcagtagcatttgagctgagccttcaataaatttttcatgtatttagccaatatttgttgagaacctaatatccgccaggcactgggcaaggtgataggtggatgatgttaaatataacaggcatggcctttacctgcatgaagtttacaagcacaaatggtggcgttaagaagtcaataagcagggggagtgaaagaggagagtgtggctggggtcttccttgaaaaggtggtattcaaactgagaagagggctgggcgcggtggctcatgcctgtaatcccaacactttgggaggccaaggcgagtggatcacctgaggtcagtatttcaagatcagcctggccaacatggtgaaaccccgtctgtactaaaaaaatacaaaaattagccgggcgcggtggcacgcacctgcagtcccagctacttgggaggctgaggcggaagaattgcttaaacttgggaggcagaggttgcagtgagctgagattgtgccattgcactccagcctgggtgacagagtgagactttcaaaaaaaaaaaaagaaatggagtcacttataccaagagtaaaggagggagagggagtaaagaagggtgctggattattccttcctttgctcattattgattctaaaaatctcacttattttctgtattcagtttcctttctattggagaatattcttggggtctgtgaatggtaaacttgcccagtctttgtttgaaaatatcttttgccctcacacttgatatgttagctagatatagaattttttgcatagcatgtgtaatgaatgtgaaagttatacatgcctctttaaaagttttcaatcaaaacagaaatagataatgtacaaagtgaaagtctttcatttcttttctcacaatttctcaaaagagaataatttttttcaaaagagagaagtttcccagggggaaccattggttacagtttgcccttttctatatatactgaaaattgtttaaagtgtaaagtatgtatactttttaaaaatgtgcacgtacacaaatgctgtactttttttttttctaaacataaataatcatgttcacatttgagcaggacacagtagttcacacctgtaatctcaactagtcaggtggctgagagtggatgattgcttgaggccaggagtttgaggctacattgagctatgattgcaccagtacactccagcctggggacagagtgagacctggtctcttaaaattaaaaagaaaatgtaaagttctttttttaattaaaaaatgataatatatgcaattttacaatatgctttttaacaatcaagcatgtacttttttccacatcagtacaatgaaatctccttcattctttgaagttgctgtatagtttctcatgatattgatacaccataatttaactatttttctattaatagacatttaagttgttttcgccccttggttttgctactatacagtatttcactgagtatctttttacttaggtaaatatatctgtagtataaattcctggacatttcaggaatgtgacgtgtctaggaatttgaccccaaaggatatgtatgcacatttaacaagttaatagatattgtcaacttgtcttcccaaaagattgtttcaatttataatcccagagtatgtctggctctaatttttgtttttcttctggttccttagaattcccgtactgattagtcaacagtggaaaatctgaagagatgcaagcaggaaaaagaaattaaaccaggtaggtagtggcactgttcatactctactgccagagcagcacacgtttttgcctgaatatctttatttctggttgaaggaagaaaatacgtaagttccaaactaaattagtgggagattttgaccttatgaagaaaaggcaggatggctcttttcagaagttatatacataacagcatgctacaatttcacagtcaagattctgttttcaggcgttttttttttaatagcatcagaaagaaaatttacctttggtggcttaagaggggatgggtttcccggccatgtacttaagcttaagcaggtggaatcatacacaggagttattagcaacattgggcctggtgccagctttcctctccaccaagtgtttgctgtaaagctgttttcacaaagaccagggcacattatgggaattttcattttaatgctgtaatagaggagcaaaagccagcaaaacccaacccaaagaaatgggttcggcccagtagtctggtgagaagggatgaagatgcagtccctccagctgagaacaaattgccattcaaagagcacaagtggcccacctggcagtatggccaccttgggtccagtgtccatagtttatgatatctaaatgtttctggcataagttaataattttaaactcagggtaacataataatcgactttttacctaaagcagcagtatttatcaacaaatctggtgaatttctttgaattgtcaagttggaagtactgggtccacagagatcttttcacccaccaggcatccatcagcatccatggatgtggttgttaaggtatcagaattgaaggctattctagattggcctacacccacctggaccttctccatagctggaattttcacaaagaggctaaagagcctggggatgagcgcatcgctctgaagagcttgccgaatccactgtgcatctgtccataagctaaggatggtgtgaggactgaaagctgcatgggagagagaaggtcttgtgattttctctctcttcagcactgtagggggcacattgcagctgtgtctggtgcagctcagtttagactcctgcctcagccaggaaaagtttttttcatttttacattaatttagcaggtatttatggagcatcttctataaattggacaccagataacaaagcaaaagtggcacagtccttgccctcaggaagcttgtgggtctggctgacagtagactagtagcagtagtctgcggtaggtccagagggctagtgggcagagggtgctgcggcttgaaaggtatgcaggagatgacttggagaagagtgggcggggacaggctgggggcttgcggagcagcacagcgaaggcctggaggcttggggggtgcagcactccatggaaattccatgggccaaacacagtgcagagggggttccctggctggagttgagtctggaggtgtccatgaatgaatctgaactttatcctgatggctctgaatggaaagtcgctggagggctttaagcaggggagagttgtgagtcaggcttaggaaggagactgtctagcttcagtttgggtaagggactgagagagttctaagggactgagagagttccgcactctgcctggcccactctcatcacctctcttcttagcgcctgtgctcctccttcccttggaacttcaagaaggcaaaggacagagcccgaagtctgagataagatagactccttggggagaaaagaggaagtggtgctgggtgggtgggtgggggcacccagtgtaaagcagagtgtacaggttgccttggacaagtcacttcacacctatgagcttcagcttccttatctattaaatgaagataataagtattactcttcttttctctcatctcatgagatatcatcatgatatcttaaaatatcatggatattttacatgcccagctagggcttccagagaaatctctctgtttcgtttgccatgtaaggatttgttgaaatcctcaagcgcacattaagtgcatcctgtcgctgcagcttatcgcctgggatgagagcagtgaagaagccctagcctcaggatcagtctcacagctccctctccctgcagccaagaaggaccggtctacagaggggagggagcaaacactgaccgaaggccaggtgtgtgcttggcaccacccacagacaaaagagtgcttgggcagagctgctagaactattatttaagccatgtgccagatgtgataagcacttacatccttctcagcctcatttagtttgatcttatgaagtacatatatattatctccatttgatagatgaggaaaccgagactcaaagaggtggaactgcttgctggtagtgacacaattgggaagaaggagaagggccggagtctggagttcgtgctctctgacttctgtgggtagcatctgccattctgctggtgctccttcagacctttcagacagtgcagaggacacagaggaatcaagggacagctgttctcttacaaaccttgaaaatcctgtacagagccctcagataaccaaaacgtggtccagaactgaatcctggggccaacatgcccatttagcacttctctcaatcagtccttttccccaggtgcattaaacagggcagctgccttcccaccctatgggcaaactgcttggcagctaggagtgtgcctgctcatctcccaggctgctttcctttgcacctcagcaaggagggcaggccgtgcatccagggaagcacatagttactccttctgccagaaggccaccccctaatctggtttaccgtggacactgaagtcactccctgtctcctggccatgaggaaaactcctttgagaggagcctctgaagccagtggagagagtaaaaagtgagaatcctgcctagttgaacaggcagttcagcctgttctggaaagagttaaggctgtgtccataccaagccatttaaagaatctgcccagtagaatcaatattgtcaaaatgtccatactacccaaagcgatctacagaattaattccattcctatcaaaattccagtggcattgcttacagaaatagaacaaataatcctaaaattcctatgaaaccatgaaagaccccaaattactaaggcaatcttgagcaagaagatctaagttggaggcatcacacaacctgatttcaaatattataggctggacatggtgactcacacctgtaattccagcactttgggaggctgaggcgggagttcgagaccaacctgggcaacatagcgaaaccctgtttctataaaagaaaaaaaaaaaatccaaaaagtagctgggcatggtggcgtgcacctgtagtcccagctactcaggaggccaaggtgggaggatcacttgagcccaggcatcgcatcaaggctgcagtgagccgtagtcatgccactgtactccagcctggctgaaagagtgagattatgtctcaaaaaaaaaaattataatgctataataatcaacacacacacacacacacacacacacacacacacacacacacacacacgactattactcagccttaaaaaagaaaatcctgacatttgcaaaaacatggttgaacctggaggacattgtgctaagtgaaatagggcagacacagaaagacaaatactacaggatctcagttatatgtggaatctaaaagagttgaactaagagagagtagaagggtggtttccagagagagtagaagggttgttggggaaatggagagatgttgagcaaaggttacaaacttgcagttataagatgaataaattttggcgacctaatgtacagcatggtaattacagttaataatatggtattgtatacttgaaatttgctaagagagtagatcttaagtattctcgtcacaaaaagtaactgtgtgaggtggtggatatgttaattagcttgattgtgataatcatgtcacagtgtgaatatataacatttttatttgtcattcataccttaataaaactgaaaaaaatttaaagaatctgcccaggtcacaggaagccatcagtcataccctgagctgttgtgtaagctcaaagagtatggtttatagcatatggatgagtgctcttgtgccaacgctgggctaaacctttacatccagtgtctaattaggtagtttctgttattatccatgttttaccaaggaggaaactgaggcttttggagattacatcatttggccaatgtaccagagctggaaagttgcataactaagatttcacttgagctttttttagctccacatcttctattttttcagctacaccaaaacgacttctttaatttagctttgcttttctgataatagtaaccaccaccctttattgagcatcttgtcatgtgagccaggcattatacatccattatttccaatcccagtagaaccttacaagtaaagtatcattgtccccgtttcacagatgaagaacctgaggttcagagaggtcaggaattttgcctcacagatttcatctgagactagagtgagctctcaactatcatcctgtacttccttcattccttaccttttcaggttcctaggaggaaaggactcaaaaaaattatgcatgaatttcctttaatttcacaacaaccctaagggttgggggttgatatctctgttttacaaaagaagaaactgaggctcagagatgttaagtgatttgctcagcgtcatgcagctagcaattggtggagccccgattcatacaggctctgacccatagcttaagcttacttgcctcccccattcccacccctcacccctcttcggctctgtctccttgcaatgggggcagaaaatccagcctttatttctccaggtcctagtagtcctgggagtctgggggatttccagctcctttgaattcccttttttggcctctactctgcctccagcacctctcttaagagtccttttcactgttgtcatagcaagggtctcatctggagggaagctgccttgaggttggaactatttggctgcttatcagcaaggcttcagggccttgccatagcaactttccaagccacccatcttgtgacctgttctgactcagggcccctgggaatcccctgggtgcagatgtttgcagtgactaggatgcagcagtcggctcccaggactctttttctggccaaggccattttaggaaggcttctgttccagctgtgctgggagagttgaggtccagagcctccaaaccttaagaatgcagggttatgtgatgtctagagctggagtttttagccaggggcttatgggttaagagccccctgtgatcataggtatggttacacacacacgcagagaatatatacttttctgggcaaagtatctgtagcttccctcaaactctcaaatgtgtctgtgacccttaaagtttaagaacactggtctagagagaacccaaagtgttgtgggccactgtgctcccttggccaccagcctctcagatgccagaatcttgagagagcacaccaggcctctagtgtttctgcttaggcatgaactgggatacagtatcaaatattgctgaagttcacaattataactataaatgtacagctgtcctttgggatgccccaagtacttttatttatttatttatttttttgagatggagtttcgctgtgttgcccaggcaggggtgcagtggcatgatcttggctcactgcaacctccgcctcctgggttcaagcaattcttctgtctcagcctcctgagtagctgggatcacaggcgtgcaccaccatgcccggctaatttttgtatttttagtagagatggggttttaccatgttggtaaagctggtctcgaactcctgacctcgtgatccgccagccttggcctcccaaagtgctgggattacaggtgtgaaccactgcgcctggtgcccctggtgctgtaaaagtacaactgtcctgtggatgccccaagtacaaccacgaaaatgcatgcccagcaccccaaacatgtcaacatgtttgaacatagtatattcaccccataagtggtagccaattttttattttattaaatattaaataaattaattttaaacacatttttgttttgttttactcttatcattgttattatttatttggtcaggagccaggaatcagatggttatttagtcactgagtgattaaaatctatatgtcaggagctgtgctatatttcaaagatacagtgacaaacaagaaaggcagggtacctaccctcttggaatcagttggaatggcagataatgaacaaatgtatcagcatcatgcctggctcacgggacatttctgtgtgtatttgtcgaatgactgttgaatgaatttcgactgagtcattattaggaagaagtcaaggtgctgcaggtggcaggcaaggaaacttcatctcttctggtgggtcagggaagaggaagagggactcaggctaaagggcctacgccccaggctgccaggaattacacaggactgtttacagggggctggcattcccatgaagactggaggtgtggggggagggctggaatactgaacaaccaagggcttaggaaccttgagtaaatgatgttaatgtgggccagaggtacggatgacatctacactctgctcaagtagtgatggtccctggcttgcaaacatgttgctcttccaggttccaagggaggctgttgttcaaccggtatttacctatgtagcaagttctgggttcggaaccctacttctctcaggaggcaggaaggatggaaggacatccctcctgcagctgaagacggcagagccccagccactgctggcagtggccgtggacacacagtgcagtgtctgagcagtgtgtgaagagactcccttactgtctgaagggcttcactcaccctacactagtgagaagcctctgaatattgtcttggaagggaagcattcacatattaagggtaaaatcaaagtcagagcaaaatttaaagtctgctctttgcccctcaagaccctgaaagtccccagtgactgtcattccactcacctcctctcccattcactgctccccagccccatggcctcttattagtctttctgggcagcaggctccccttgcctcttgcatgctgtgccctctgcctcgcatacttagatgtatatgcagaagtggtttctaaactcctctctctcatcatgtgtgtgggctgtgatacccaaccatcagtaacagcagctgatgaggacagtgatcattagctagagagcacaccctcagtcgctccacccagcattattagaataataataattccccaccaggtccccccacccggcattattagaataataataatcccccaccagatccccccacctggctttattagaattactatgagaaactatcctctagtgattctgttaattgtgatttttgcccccctactaccactggttaagaattacgggcttatgaactgagctccctaactagaccatggacttccctcaggggcacaatggtatcttactgtttttgtatctgtggtatctagtcccaagcctagtatacactgagggatcagtgaaatttttctgaaggaatggatgaatactatagagataatatcttgcttcttttcattctccacggtgtattttggagatgcattttatagaattagaggaactagaattgacacaaactgtcttcaacccatgaaagtctgtgcttccatgaaggtctctggaaagcagcagaacagtccatctggatcactgcttggtggctgggcatgctgggtcctccccgggcctcctgctgcggatgtatgatctaaatttgccgaggctcagctacacagcaaggttctcagagagtggcagtctccatcctactgtgaaaggaggggcagttttccaaggacttccttgctttcctgcccttccttcagagctagaagactcttacctcccttaccccagagctagaagtaacattagagattgcttcagttatccacttctgcataatccatcacccctgttactcagtggtttaaaacaacagcaatagtttcttatatctcatggtttctgtgggtcaggaatttgggaacagcttggctgggcagttctggcttggatcttttatgcagttgcagttagatggtggctggaactggagcagcttggggccagcaccgctgaaggctggccggctgctgctctttcctggccgtctcaggacctctcccctgtggttacttcatagggcctgtttgggcttcctcacagcacggccacctcagatttcccatatgcagctcaatgctctagaggcaggtttccccagagagagctaggtgaaagctgtataaccctttatagcctcatcttggaggtgacacaaaatcatttttgttgcattctatttgttagaggtcattaaggccagctcgttcggggaaattgaaattaaactctacctcccgagaggaggaatgtcagataatttgcagacatgtttcagaaccaccacagagatacccagtttcccccttcattccacacttgagactcccgaggtttgaggggaagagccttgtccagaggtgcccagcctggcatgggcagacctggagtgtgacccagcccctaggcctttggcaggcctgccaggaagtgatctcactttcccttccttcctgtcccctcacagtaagatagagactgccactctctgggaaccttgctgtgtagctgagcctcagcaagtttgataatacagacacagcaggaggcctggggaggacccagcatgcccggccaccaagcagtgatgcagctggactgttccgcagctttccagagacctccatggaagcacagacttccatgggttgaagagagtttgtgtcacaattccagtccctagccctggccctgtgtgaagtagtaacaccgccctgccagtaggatatagctgctgaggaggtaagagttttaaaaaattcataccccaaaataattatttttactcttgctgtgaagttagataccaaagagtagaatgtggtggtagaatcaagagagtcaacccaacatcactgaaaagattctgaaggtttgtatccagctgaatatccaaaacaggatgttgcttaagcatgggtaaaatgcatctggtgtatgttttagacagccttgtactatgttttccagggacttgcttactttcttgcccttccttaagaaatgccttattatgaagctgggggcaggggaaaaagaaggtcagaaaagggaatgggtacttttcagtaaatccatactacatgccaggcataatactaattcactcccctgctttatagcctaatagcacaggctccatctggctccaagctccctaaccttgctgagtttcagctgcctcttttgtactatgggataatgatactttctgtcatagagttgctataaaattaaatgcttgtaagatgcttagcacagtctggcatgcagtaagaaagaactgtgtaacaggccaggcaccgtggctcaagcctgcagtcccagcactttaggaggctgaggcgggcggatcacaaggtcaagagatcgagaccatcctggccaacatggtgaaaccctgtctctactaaaagtacaaaaattagctgggcatggtggcgcacacctatagtcccagctacttgggaggctgaggcaggagaatcgcttgaacctgggaggcagaggttgcagtgagccaagatcgcgccgctgcactccagcctagtcacagagcgagattctgtctcaaaaaaacaaaaaacaaaaaacaaaaaaactgtataactgttggctccaattaatccccacagccactttttaagacaagtgtgagccctcccattttatagaaggggtgtctgcagttaggtgaggtgcccagcatcatgtgccactgtagggacagcagctgagactctgaagtccttgtggcatccaccacaccacattaccctccgggcagctctgccagggctttcctgacatgcaatagttgggggcagaggaactcaggaggctttgtgccctacaggagccccatgtcaggtcctagagcaagaacatttgaaaaaccaaggccaggaatccatttatccacttaggaggctctatagggagcagggttacagagaatgttgtacacagaggaaatagtctagtaaaggctttgaggtcaggaattaaatgaggtttgaggatttaaagagaggcccagtgtgaccagagcaaaatggaccaagaagagagtagaaatgagacaaaggctcatctgcagaggcaggcagggccaggtcaatgcagggcttcagggactggcatcaggagagtggatttcactagatgtgaaatagaaaagcatcagaagttgaacgaagcagggaaattccagtgatccaatttccattttgagaacgttaccctgcctgccatataaaaaatagaccctgggctaggggtgagagagacacaggactctggtcagggtctctgctcagagtcctggtgagacattccggagcctgggtggtgcatgtggaggagagaggtcagcagattcaagctctgttttgcaggtagaaacaaaaggaccaggctgggcactgttgctcatgcctgtaatcccagctctttgggaggccaaggtgggaggattgcttgaggccaggaatttaagactaggctgggcagcatcgtaagaccctgtctctacaaaaacattaaaaaaaaaaagaagaagaaatgacaggactgggtaaagaattgtccatgggtggtgaagaagaagcgaggtcagggatggtcctgggtttccagctgggcagatggtggtgcccttgctcagttgggaaggccgtggcgagcaggctggtgacttgacgtctgaagcttgcagtgctgtgggatagccaaatgacacgctcaataggctgagtcagaaatctagaactcttaagagagggttgcagctctttgaaggtcaccaacatagattatttcgggaaaggataagagcccctcgggagcaaacagaagagactggcgtcctaacacaaaggtcccggcagtagcaggtgcctgtgcagactggttggagggaggcccaaagggtgtggtgtctggaagtcccatgaagagaatggtccgggaagaaatgagttggaagaggaggacagaaaggtgtccctggggataggcaccgtagaagtcactcaggaccttgtctgacttgagcaccctgaccttcccttcctatcactgcctgcatccaggcctgcttgggtctaggcctggcaggtgcagaggccaaggcccggcctctctgcctccaaacaaagcctcacccagggccactctttgaatggcaacaggcactgcccaggcaggcgacaggctcctctctggtgaccttgtgctggatgtgccccaaggcgctgggtagggctttgcagccagccccaggcaggccacacatggatagaaccggcagccctcccttttcccaggttcttggaatattctcattttggggctctgagttttctgttggcctcagtgcctctcttttctggctttctatcacagagagaagccgctacccttgaaatttgatgaatgcctgttcagtaggccctggcatttctgtttccacggccctttcgtccctcagagaagccttagagagcattttgcccacccctgataaaacttctcccataagaccaggtcccacttctgtgcttcatgtcttctgcaaaagtctgtttgctttttgtatggtttctgcaaatactgaatttttgaaaaagaaaaaaaaacaggaaatgacctttctagtatatttggaaaacaatttggagcttgtaatggaatctgcctgagcaatgaggactaatagctgcagacttggaacagaccatgtagctcttggcagagcctggggcctcttcagtttacaaagctggggggagtattagaaacccacgggagaagtggcttcctgtggggaaatgcccagagcaggcacctgcaggcactgtaacctctgaccccagggccccaaaaggcctggggacagagtataagggcttcaccctttgtcctgggcattcaaggtcaatcacatgtctggcaatcatccagatcccacaagataccaaaacctcctgaggatgaggaaaagaaagagcttcattctttagcaccctgtagggctcaggctgagctagaagattctagattgtttttagactcaaattgcctgttggctctctgggtccctctctatccaacttttctgtagatttcagcaaaaaccacctcctcagagaggcctttcctgatcatacagccattaactgcatgatccacatgcagagaaccctctcctcttctcccatagcacataccataatctgtgataagattcatttacttgtgcagtgcctttttctctttacacattgtaaatatcttttttagtttccagtatataccctatgcccggcacagtgcctggcatgtagaagttgctcagtacattgaatgaataaatgaaatatcaagactggaagacttggaggccaggtgcggtggctcatgcctgtaatcccagcactttgggaggccgaggcaggtggatcacttgaggtcaggagttcaagattaacctggccaacatggtgaaaccccatctctattaaaaatacaaaaaaaaaaaaattagccgggtatgttggttcatgcctgtaatcccagctacttgggaggctgaggcaggaaaagcacttgaaccggggaggtggaggttgcagtgagcagagatcatgccactgcactccaacctgggcgacagagtaagactccatctcaaaaaaaaaaaaaaaagactggaagacttggagatcatatttcaaacttcattatttagatggtgggaaaggaagctgagagagaaggggactcatcaagggtcaccctattgcgcgggtattgaaccagatcttcagccactgttatgatgcagggccgcacattctttgctcttctttccctgtaatctagaacatcttctattattcacttgttcatcagctattcattgagcttcaagtatgtgcagggccttctggacgtaacagtaaacacaccagccagggtcaccacttctggggaatttatattcttaccacacaacaccataaagcaccaaagaaggaagttttaatcttctgtagcaccgttaaacagagtaaaaacaaaggagctgaatgaaatgtccaaaggcaggttttactaactcagcccccaaatgaaccatcctaatcatttattaattgcattccacttacattccccatcacttactacactttttgcatcaccatcttattgaatcttcataacagccccctgaactgcagggtgtgactgttagccccgctttgctgaggtgaggggagttgtgcacggcccacagctggtaaacaacaaagctgggctggacgagcaccctagatgccttctaccctgccacccattcccctcagagatttgtaatgtcatcagggactcccaagggggcagtgtgatgtggggaaaagagctctggaccgggagttaggaccgctagatcaagaaccctgggcaagtgccttgccctttctgagcctccgtttccgcagctgttgatgagaggcttgtctagatgagctctgggatgtctttcggttagattctacaacaacttttcattaattgaacaggtatttgccctgtgatggtcctgaatgaatcaaagctgtctccctgctggagataggtcatgggctgttggaagtaaaggtttagaactcaggagagaaaagactgtagacccatgtgttagggcatattagtaatcatatattgagaacatccttccgtgtcaatatacataaatggattggcctgattctttttaatcattgaaggtttctgaactgagcatgaggatgagccaactgatgttggggaatgtccctcttgaagtagaggacagagggcttgaggatgaattgggggtgggggtggtgaggaataagtgagaagactgggggcagaaaagccagttggggaaggttgtagtagactggatagagatgatgaagcgtaactgaggccatgattactgcatggagaaaatgggaagatggacctgaagagagaaaataattgaacctgggtaattgagctttaaggtgcaggatgccttcttaaagagaggaagaagtcaggcatgagttacgggtaataggtttttgacttgcataattgattgtggaggtggctcctgactaagggaatgaatgagagagagtcctggaggagggagagcataattttgttgatatcctccgggaggattcatctagatgtctgcagctcagcaatgaggggatcgacattgaaatgaatggaagatgatgtcatgagagagaacgagacgtgtagaacaattagagaaacattagaagagagtaaaggatggaattaaggagatatacaagtagtcaaggtgttggactaggagaatgtaaaagagcattctgagaagttgaaggcagttgctttactgcctgagccttagtttcctcatttctaaaatgaggattagaatcgtgcctactcgttgtgtttagggttacatgagagaatgtgtggaaggcacttaccttgcatatcagaagtagaactcatgcaataattcatcattcattccgtaagtaagagtcaagcaccagcatatgccaggcagctgggccagccctttggagtacacagaggagcaaaagggaagtctgagtgcctgaccttgtgggagaggaattgtgaaagaaagaagactcaatatcataaaaatgtgatttctatctacattcaggtaccagatattactatatatatttaatgcagtcctgataaatacaagataaattgggggacaagttaaatgactattaagtttataagaaaacatagatcagcaaaaacagccagaaaaaaaaaatctaaagtcaaaaaagatttgagctatgagaaggaaaccatcctacaacatgatactagtatatgagtagacagatcagctggagagattaaaagattcagaaacaggccaggtgcggtggctcacgcctgtaatcccagcactttgggaggccgagacgggcggatcacgaggccaggagatcgagaccatcctggctgacacggtgaaaccccgtctctactgaacaaaatacaaaaaattagccgggtgtggtagcaggcgcctgagtcccagctactcaggaggctgaggcaggagaatggcgtgaacccaggaggcggagcttgcagtgagtccagattgcaccactgcactccagcctgggcgacagagtgagactccgtctcaaaaaaaaaaaaaaaaaaaaaaagattcagaaacagaccccaatacacagttttgtatgtaacaatgatagctttttacatcaatgaggaaatgatggattactccacaaatgatttgagataggtagaaaaaattaaggtggctcgctaattcataccttattacagataaattctagatcaaagatttaaatgtgaaaagggaagccataaaagtactagagaggccaggcgtggtggctcacacctgtaatcccagcagtttgggaggctcaggcaggagtatcacttgagcccaggagttcaaaaccagcctgggcaacatagtgagaccccatctcttaaaaaaaaaagaattagctgggcacattagcatgcacctgtagtcccagcttctcaggaagctaagctaggaggatctcttgagcccaggagttcaaggttgctgtgagctaggctggcaccgctacactccagcctgggtgactccagaccctgtctcaaaaaacaaagtaccagaaataaacaaagggatttctttactaatcttagagtggggaagacatttctaattatgttacaaagcccagaaaccataaaataaaataaagatcaattttactaatgaatataaaaatatgtatgtggggagaagtgccgaaaaataaagtcaaagtacaaatgacaagtaaaaaatactagtaactcctaattagacaaaagactaattgccttaatatattaagaactcctacaaatcaataagaaaaagacctaaaatccattagaagtgggcaaaagaatttgaagaaacagtaaacagaaaaggagatgcaagtgggaagatgctcaggttcactcctaggagcagtaggaactaaaacaatcaggcactggttttaaaaccaccttttagattaggaacaaaacagcattaagaagactgtggtgaaggaaagtgctcatctgatatacctactggggattgctatggtttgaatgtgttccctccaaaataccaatgtgataatattaagaggtagggcctttaagaggtgattaggtcatgagggctccttccttgtgaatgggattaggcaccttttataaaagggcttgaggccaggcatggtggctcacgcttgtaatctcagcactttgggaggctgaggtggctggatcacccgaggtcaggagttcaagaccagcctggccaacatggtgaaacctcatctctcccaaaaatataaaaattagctgggcgtggtggtgcacacctgtaagcccagctacttgggaggctgaggcaggaaaatcacttgaatctgggaggaggaggttgcagtgagccgagaccatgccactgcattccagcatgggcgacagaacaagactccatcaaataaataaataaatgggcttgagggagtgagtttgcccctttttgcctttctgccatttgctctgtgagaacacagtgttcaaggtgccctcttggaagcagagagcaggcctcaccacaggctggcgccttgatcttggacttcccagcctccagaactgtgtgaaataaatttctgttctttagaaattactgagactcagatattttgttgtagcagcacaaaacggactgagagacaggaactaacttctgtggggagaagttggcaatacctgttataataaaaaagtcacagatcctttgaggtggcaattccacttttatagaaacaatcctcaggtccatcaacagggaagtaattaaatcaatctacaacagtgagacaacagagtatcatgcagacaataaaaggaacaatttagttattactttgggtttgttttcagtgtgttgatgtaatcagtgctgcagtggcttcagagtgatctacagttgtttccaaggtgtgtgtgtgtgtgtgtttgtgtgtgtatatgtgtgtgtgtgtgtatatatatatatatatatttttttttttttttttttgaaatagagtctcactgtcacccaggctggagtgcagtggcgcaatcccggctcactgcagcctctgcctctcgggttcgagcaattctcctgcctcagcctcctgagtagctgggactacaggcgtgcaccaccacacccagctaatttttgtatttttagtagagatggggtttcaccatgttggccaggctagtcttgaactcctgacctcaggtgatccacccgcctcagcctcccaaagccaagacacatttttaaatgaaaaaaaggcaagatggaaaataaatttttttttttttttttgagacggagtctcactctgtcacccaggctggagtgcagtggcacgatctcggctcactgcaagctccacctcctgggttcacgccattctcctgcctcagcctcccgagtagctgggactacaggcgcccactaccacgcccagctaattttttgcatttttagtagagacggggtttcgccatgttggccaggatggtctcgatctcttgacctcgtgatccacacccaccccccgccgcctcggcctcccaaagttctgggattacaggcatgagccaccatgcccggccaaaattttgttttaaataaaggaaaaaggaagggaaggagaaaaagggggaacatatatattgcataaattttgtctggaaggacaccaaaacgtgcttgccttggggagggtgtctggatcggatgggaagggagactaagctcttatctctgtccttttggaccttttgagttttagaccacatgcacacataatctaaaattaagtaattttaagatgaagtgaatgtgttcactataaaaaggaaatataacagattttaaaattacttataaaaatattaatgtatgtaattatatcactggtattctttttcatttaactatatgtgaacattttgccatttctttaaaaaatattcacaaacatcattttaatgcctgaatggtatttcatttagatacaaattagttaagtatgtatatattaataattctccattgtccgtttaggacatgtgacacatccatttaggaactcattttggtgtctttagtttcctgctattataaataatactgtgggccaggcgcagtggcttaggcctgtaatcccaacactttggaagtccgaggcaggaggatcacttgagcccaggagtttgagaccacgagtttgagaccaccttggttaacataatgagattcccatccctgaaaaaaaatgagccagacatggaatagtcccagctactcaggaggctgaggcaacaggattgcttgagcccaggaagttgaggctacagtgagccatgattgtaccactgcactccagcctgtgtgacacagcgagaccctgtctcaaaaaaaaaaaaaaaaatactatgaggaacatctttgtacattttatcttcatgtagatcttggattattttcttagaatagattattataaactgatttagtagctaaaagatatggaaaaagttgaggtttctggatacacactgtcaagtcactgcccaaggaggtcttggaagtttacagtctcattaacagggtttgagaatgaccattttctgacaggatttccaactctgaggattctttatttccccatttgctgttgactctaaagatgagagggtgagtgacgaatataaat
